United States Patent
Zhang et al.

(10) Patent No.: US 11,673,953 B2
(45) Date of Patent: Jun. 13, 2023

(54) DLL3 TARGETING CHIMERIC ANTIGEN RECEPTORS AND BINDING AGENTS

(71) Applicants: ALLOGENE THERAPEUTICS, INC., South San Francisco, CA (US); PFIZER INC., New York, NY (US)

(72) Inventors: Yi Zhang, Foster City, CA (US); Thomas John Van Blarcom, Oakland, CA (US); Siler Panowski, Berkeley, CA (US); Silvia K. Tacheva-Grigorova, Redwood City, CA (US); Barbra Johnson Sasu, San Francisco, CA (US)

(73) Assignees: ALLOGENE THERAPEUTICS, INC., South San Francisco, CA (US); PFIZER INC., New York, NY (US)

( * ) Notice: Subject to any disclaimer, the term of this patent is extended or adjusted under 35 U.S.C. 154(b) by 374 days.

(21) Appl. No.: 16/802,822

(22) Filed: Feb. 27, 2020

(65) Prior Publication Data
US 2021/0107979 A1    Apr. 15, 2021

Related U.S. Application Data

(60) Provisional application No. 62/969,976, filed on Feb. 4, 2020, provisional application No. 62/812,585, filed on Mar. 1, 2019.

(51) Int. Cl.
| | |
|---|---|
| *C07K 16/28* | (2006.01) |
| *A61P 35/00* | (2006.01) |
| *A61K 39/00* | (2006.01) |
| *C12N 15/63* | (2006.01) |

(52) U.S. Cl.
CPC .......... *C07K 16/2809* (2013.01); *A61P 35/00* (2018.01); *C07K 16/2887* (2013.01); *C12N 15/63* (2013.01); *A61K 2039/505* (2013.01); *C07K 2317/24* (2013.01); *C07K 2317/565* (2013.01); *C07K 2317/622* (2013.01); *C07K 2319/70* (2013.01)

(58) Field of Classification Search
CPC ............ C07K 16/2809; C07K 16/2887; C07K 2317/24; C07K 2317/565; C07K 2317/622; C07K 2319/70; C07K 2319/03; C07K 2319/33; C07K 16/28; C07K 14/705; C07K 14/7051; C07K 14/70578; C07K 14/70596; C07K 16/18; A61P 35/00; A61K 2039/505; A61K 39/0011; A61K 2039/5156; A61K 35/17; C12N 15/63; C12N 2510/00; C12N 5/0636
See application file for complete search history.

(56) References Cited

U.S. PATENT DOCUMENTS

| | | | |
|---|---|---|---|
| 4,816,567 A | 3/1989 | Cabilly et al. | |
| 5,571,894 A | 11/1996 | Wels et al. | |
| 5,587,458 A | 12/1996 | King et al. | |
| 5,641,870 A | 6/1997 | Rinderknecht | |
| 5,821,337 A | 10/1998 | Carter et al. | |
| 5,827,642 A | 10/1998 | Ridell et al. | |
| 5,830,462 A | 11/1998 | Crabtree et al. | |
| 5,834,266 A | 11/1998 | Crabtree et al. | |
| 5,869,046 A | 2/1999 | Presta et al. | |
| 5,869,337 A | 2/1999 | Crabtree et al. | |
| 6,040,177 A | 3/2000 | Ridell et al. | |
| 6,075,181 A | 6/2000 | Kucherlapati et al. | |
| 6,165,787 A | 12/2000 | Crabtree et al. | |
| 6,248,516 B1 | 6/2001 | Winter et al. | |
| 6,319,494 B1 | 11/2001 | Capon et al. | |
| 6,797,514 B2 | 9/2004 | Brenson et al. | |
| 6,867,041 B2 | 3/2005 | Berenson et al. | |
| 6,905,874 B2 | 6/2005 | Berenson et al. | |
| 6,982,321 B2 | 1/2006 | Winter et al. | |
| 7,087,409 B2 | 8/2006 | Barbas et al. | |
| 7,527,791 B2 | 5/2009 | Adams et al. | |
| 7,709,226 B2 | 5/2010 | Foote | |
| 7,741,465 B1 | 6/2010 | Eshhar et al. | |
| 8,486,693 B2 | 7/2013 | Park et al. | |
| 2003/0130496 A1 | 7/2003 | Winter et al. | |
| 2011/0286980 A1 | 11/2011 | Brenner | |
| 2012/0130076 A1 | 5/2012 | Holt et al. | |
| 2014/0171649 A1 | 6/2014 | Li et al. | |
| 2014/0286987 A1 | 9/2014 | Spencer et al. | |
| 2014/0364590 A1 | 12/2014 | Stull et al. | |
| 2015/0266973 A1 | 9/2015 | Jarjour et al. | |

(Continued)

FOREIGN PATENT DOCUMENTS

| | | |
|---|---|---|
| EP | 404097 B1 | 9/1996 |
| WO | WO9301161 A1 | 1/1993 |

(Continued)

OTHER PUBLICATIONS

Murphy et al. (Journal of Immunological Methods, vol. 463, p. 127-133, 2018) (Year: 2018).*

(Continued)

*Primary Examiner* — Hong Sang
*Assistant Examiner* — Sung Min Yoon
(74) *Attorney, Agent, or Firm* — Allogene Therapeutics, Inc.

(57) ABSTRACT

Provided herein are DLL3 binding agents and chimeric antigen receptors (CARs) comprising a DLL3 binding molecule that specifically binds to DLL3; and immune cells comprising these DLL3-specific CARs, e.g., CAR-T cells. Also provided are methods of making and using DLL3-specific CARs, and immune cells comprising DLL3-specific CARs.

31 Claims, 39 Drawing Sheets

Specification includes a Sequence Listing.

(56) References Cited

U.S. PATENT DOCUMENTS

| | | |
|---|---|---|
| 2016/0046700 A1 | 2/2016 | Foster et al. |
| 2017/0088620 A1* | 3/2017 | Nioi ................... A61K 39/3955 |
| 2017/0283500 A1 | 10/2017 | Wiltzius et al. |
| 2018/0237511 A1* | 8/2018 | Beil ....................... C07K 16/28 |

FOREIGN PATENT DOCUMENTS

| | | |
|---|---|---|
| WO | WO1994025591 A1 | 11/1994 |
| WO | WO2012079000 A1 | 6/2012 |
| WO | WO2012129514 A1 | 9/2012 |
| WO | WO2014127261 A1 | 8/2014 |
| WO | WO2015090229 A1 | 6/2015 |
| WO | WO2015120096 A2 | 8/2015 |
| WO | WO2015127407 A1 | 8/2015 |
| WO | WO2016138038 A1 | 9/2016 |
| WO | WO2017021349 A1 | 2/2017 |

OTHER PUBLICATIONS

Edwards et al. 2003. The remarkable flexibility of the human antibody repertoire; isolation of over one thousand different antibodies to a single protein, BlyS. Journal of Molecular Biology 334:103-118 (Year: 2003).*

Saunders LR, et al., A DLL3-targeted antibody-drug conjugate eradicates high-grade pulmonary neuroendocrine tumor-initiating cells in vivo. Sci Transl Med. Aug. 26, 2015;7(302):302ra136; "Generation and characterization of DLL3-specific monoclonal antibodies" (Year: 2015).*

Van Dijk, Marc A., et al., "Human antibodies as next generation therapeutics", Curr Opin Chem Biol, vol. 5, No. 4, pp. 368-374, (2001).

Vollmers, H. P., et al., "Death by Stress: Natural IgM-lnduced Apoptosis", Methods Find Exp Clin Pharmacol 2005, 27(3): 185-191.

Vollmers, H. P., et al., "The "early birds": natural IgM antibodies and immune surveillance", Review, Histol Histopathol (2005) 20: 927-937.

Al-Lazikani, Bissan , et al., "Standard Conformations for the Canonical Structures of Immunoglobulins", J. Mol. Biol. (1997) 273, 927-948.

Almagro , et al., "Humanization of antibodies", Frontiers in Bioscience, vol. 13, pp. 1619-1633, (2008).

Baca, Manuel , et al., "Antibody Humanization Using Monovalent Phage Display", The Journal of Biological Chemistry.

Basu, Sreemanti, et al., "Purification of Specific Cell Population by Fluorescence Activated Cell Sorting (FACS)", Journal of Visualized Experiments, (41), e1546, doi:10.3791/1546 (2010).

Brenner, Malcom K., et al., "Adoptive T Cell Therapy of Cancer", Curr Opin Immunol. Apr. 2010; 22(2): 251-257. doi:10.1016/j.coi. 2010.01.020.

Brinkmann, Ulrich , et al., "The making of bispecific antibodies", MABS, 2017, vol. 9, No. 2, 182-212.

Brodeur, Bernart R., et al., "Mouse-Human Myeloma Partners for the production of Heterohybridomas", Monoclonal Antibody Production Techniques and Applications, pp. 51-56, 3Mercel Dekker Inc, (1987).

Carter, Robert H., et al., "CD19: Lowering the Threshold for Antigen Receptor Stimulation of B Lymphocytes", Reports, Science, vol. 256 pp. 105-107.

Chothia, Cyrus , et al., "Conformations of immunoglobulin hypervariable regions", Nature■ vol. 342 . 21/28 Dec. 1989.

Chothia, Cyrus , et al., "Structural Repertoire of the Human VH Segments", J. Mol. Biol. (1992) 227, 799-917.

Courtois, Anthony , et al., "Complement dependent cytotoxicity activity of therapeutic antibody fragments is acquired by immunogenic glycan coupling", Research Article, Biotechnology of Human Disorders, Electronic Journal of Biotechnology, vol. 15 No. 5, Issue of Sep. 15, 2012.

Dall'Acqua, William F., et al., "Antibody humanization by framework shuffling", Methods, vol. 36, pp. 43-60, (2005).

EPO , "International Search Report & Written Opinion", dated Aug. 5, 2020 for PCT/US2020/020042.

Eshhar, Zelig , et al., "Specific activation and targeting of cytotoxic lymphocytes through chimeric single chains consisting of antibody-binding domains and the gamma or zeta subunits of the immunoglobulin and T-cell receptors.", Immunology; Proc Natl Acad Sci U S A. Jan. 15, 1993; 90(2): 720-724.

Finney, Helen , et al., "Chimeric Receptors Providing Both Primary and Costimulatory Signaling in T Cells from a Single Gene Product", J Immunol Sep. 15, 1998, 161 (6) 2791-2797.

Flatman, Stephen , et al., "Process analytics for purification of monoclonal antibodies", J. Chromatogr. B 848 (2007) 79-87.

Gross, Gideon , et al., "Therapeutic Potential of T Cell Chimeric Antigen Receptors (CARs) in Cancer Treatment: Counteracting Off-Tumor Toxicities for Safe CAR T Cell Therapy", Annual Review of Pharmacology and Toxicology; vol. 56:59-83 (Volume publication date Jan. 2016) https://doi.org/10.1146/annurev-pharmtox-010814-124844.

Holliger, Philipp , et al., ""Diabodies": Small bivalent and bispecific antibody fragments", Proc. Natl. Acad. Sci. USA, vol. 90, pp. 6444-6448, Jul. 1993, Biophysics.

Hudson, Peter J., et al., "Engineered antibodies", Review, National Medicine, vol. 9, No. 1, (2003).

Kalos, Michael , et al., "T Cells with Chimeric Antigen Receptors Have Potent Antitumor Effects and Can Establish Memory in Patients with Advanced Leukemia", Science Transnational Medicine, vol. 3 Issue 95 95ra73, 2011.

Kam, Nadine Wong, et al., "Carbon nanotubes as multifunctional biological transporters and near-infrared agents for selective cancer cell destruction", PNAS, vol. 102, No. 33, pp. 11600-11605.

Karlsson, Robert , et al., "Kinetic and Concentration Analysis Using BIA Technology", Methods: A Companion to Methods in Enzymology 6, 99-110 (1994).

Kashmiri, Syed V.S., et al., "SDR grafting—a new approach to antibody humanization", Methods, vol. 36, pp. 25-34, (2005).

Klimka, A., et al., "Human anti-CD30 recombinant antibodies by guided phage antibody selection using cell panning", British Journal of Cancer, vol. 83, No. 2, pp. 252-260, (2000).

Kozbor, Danuta, et al., "A Human Hybrid Myeloma for Production of Human Monoclonal Antibodies", The Journal of Immunology, vol. 133, No. 6 (1984).

Krause, Anja , et al., "Antigen-dependent CD28 Signaling Selectively Enhances Survival and Proliferation in Genetically Modified Activated Human Primary T Lymphocytes", The Journal of experimental medicine vol. 188,4 (1998): 619-26. doi:10.1084/jem.188. 4.619.

Li, Jian , et al., "Human antibodies for immunotherapy development generated via a human B cell hybridoma technology", PNAS, vol. 103, No. 10, pp. 3557-3562.

Lonberg, Nils , "Fully human antibodies from transgenic mouse and phage display platforms", Current Opinion in Immunology, 2008, 20:450-459.

Lonberg, Nils , "Human antibodies from transgenic animals", Review, Nature Biotechnology, vol. 23, No. 9, pp. 1117-1125 (2005).

Morrison, Sherie L., et al., "Chimeric human antibody molecules: Mouse antigen-binding domains with human constant region domains", Proc. Natl. Acad. Sci., USA, vol. 81, pp. 6851-6855, (1984).

Muller, Dafne , et al., "Bispecific Antibodies for Cancer Immunotherapy", Review Article, Biodrugs 2010; 24 (2):89-98.

Niculescu-Duvaz, I. , et al., "Antibody-directed enzyme prodrug therapy (ADEPT): a review", Advanced Drug Delivery Reviews 26 (1997) 151-172.

Osbourn, Jane , et al., "From rodent reagents to human therapeutics using antibody guided selection", , Methods, vol. 36, pp. 61-68, (2005).

Padlan, Eduardo A., et al., "A Possible Procedure for Reducing the Immunogenicity of Antibody Variable Domains While Preserving Their Ligand-Binding Properties", Mol. Immunol, vol. 28, pp. 489-498, (1991).

(56) References Cited

OTHER PUBLICATIONS

Payne, Gillian, "Progress in immunoconjugate cancer therapeutics", Pipeline, Cancer Cell, vol. 3, pp. 207-212, (2003).

Pluckthun, A., "Antibodies from *Escherichia coli*", The Pharmacology of Monoclonal Antibodies, Chapter 11, pp. 269-315 (1994).

Porter, David L., et al., "Chimeric Antigen Receptor—Modified T Cells in Chronic Lymphoid Leukemia", N Engl J Med 2011;365:725-33.

Presta, L. G., et al., "Humanization of an antibody directed against IgE.", J Immunol 1993; 151:2623-2632.

Riechmann, Lutz, et al., "Reshaping human antibodies for therapy", Nature, vol. 332, pp. 323-327, (1998).

Rosenberg, Steven A., et al., "Adoptive cell transfer: a clinical path to effective cancer immunotherapy", Nat Rev Cancer. Apr. 2008 ; 8(4): 299-308. doi:10.1038/nrc2355.

Rosok, Mae Joanne, et al., "A Combinatorial Library Strategy for the Rapid Humanization of Anticarcinoma BR96 Fab", The Journal of Biological Chemistry, vol. 271, No. 37, Issue of Sep. 13, pp. 22611-22618, 1996.

Sadelain, Michel , et al., "The promise and potential pitfalls of chimeric antigen receptors", Current Opinion in Immunology 2009, 21:215-223.

Sims, M. J., et al., "A humanized CD18 antibody can block function without cell destruction", J Immunol 1993; 151:2296-2308.

Song, De-Gang , et al., "CD27 costimulation augments the survival and antitumor activity of redirected human T cells in vivo", Blood (2012) 119 (3): 696-706.

Stockmeyer, Bernhard , et al., "Triggering FCa-Receptor I (CD89) Recruits Neutrophils as Effector Cells for CD20-Directed Antibody Therapy", J Immunol 2000; 165:5954-5961.

Syrigos, Konstantinos , et al., "Antibody Directed Enzyme Prodrug Therapy (ADEPT): A Review of the Experimental and Clinical Considerations", Review, Anticancer Re~Earch 19: 605-614 (1999).

Trail, Pamela A., et al., "Monoclonal antibody drug immunoconjugates for targeted treatment of cancer", Symposium in Writing, Cancer Immunol Immunother (2003) 52: 328-337.

Tramontano, Anna, et al., "Framework Residue 71 is a Major Determinant of the Position and Conformation of the Second Hypervariable Region in the V H Domains of Immunoglobulins", J. Mol. Biol. (1990) 215, 175-182.

\* cited by examiner

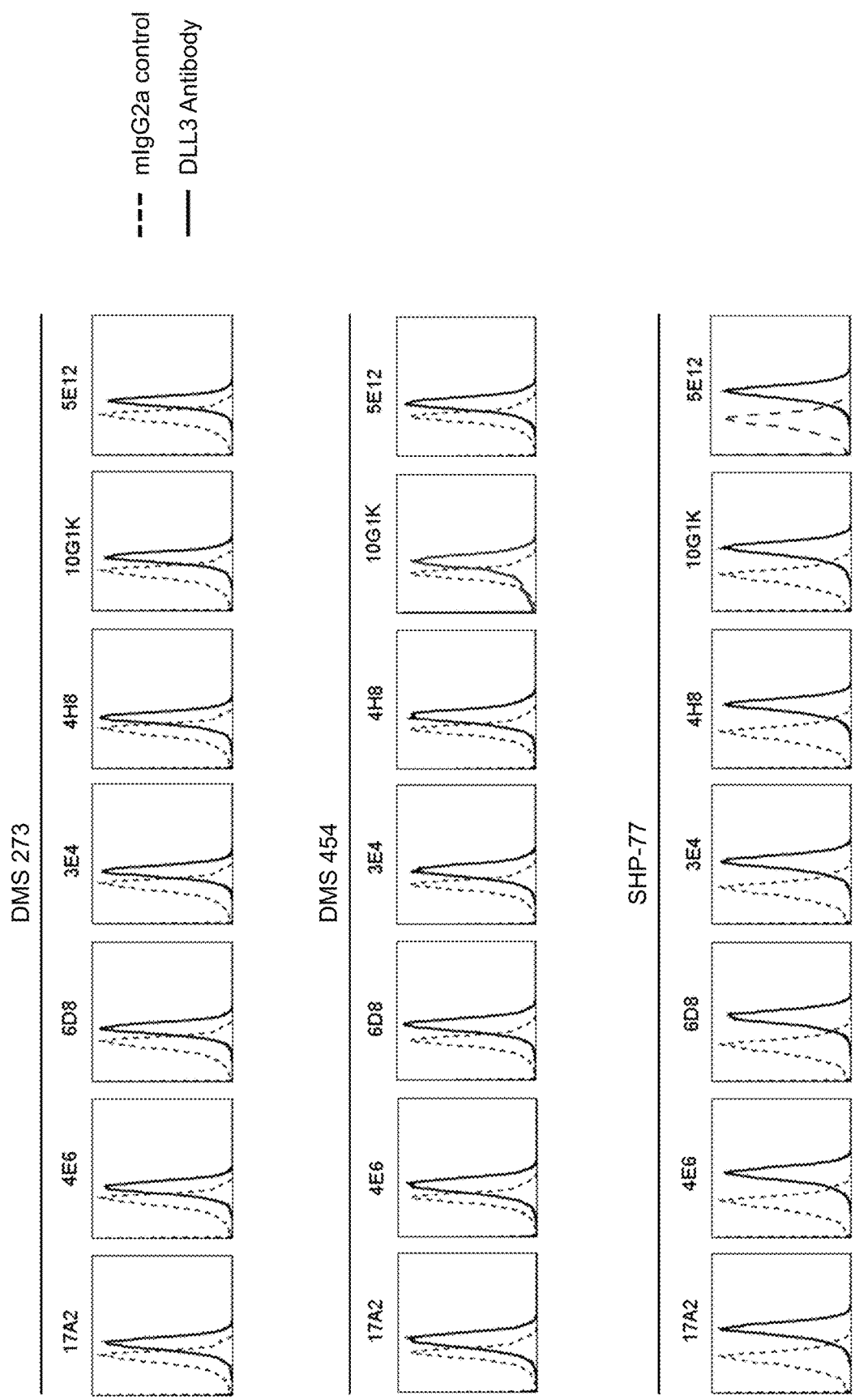

FIG. 2B

| SEQ ID NO | Name/Component | Sequence |
|---|---|---|
| 556 | Human DLL3 complete ECD | METDTLLLWVLLLWVPGSTGYPYDVPDYAGMLAGVFELQIHSFGPGPGAPRSPCSARL PCRLFFRVCLKPGLSEEAAESPCALGAALSARGPVYTEQPGAPAPDLPLPDGLLQVPFRD AWPGTFSFIIETWREELGDQIGGPAWSLLARVAGRRRLAAGGPWARDIQRAGAWELRFSY RARCEPPAVGTACTRLCRPRSAPSRCGPGLRPCAPLEDECEAPLVCRAGCSPEHGFCEQP GECRCLEGWTGPLCTVPVSTSSCLSPRGPSSATTGCLVPGPGPCDGNPCANGGSCSETPR SFECTCPRGFYGLRCEVSGVTCADGPCFNGGLCVGGADPDSAYICHCPPGFQGSNCEKRV DRCSLQPCRNGGLCLDLGHALRCRCRAGFAGPRCEHDLDDCAGRACANGGTCVEGGAHR CSCALGFGGRDCRERADPCAARPCAHGGRCYAHFSGLVCACAPGYMGARCEFPVHPDGAS ALPAAPPGLRPGDPQRYLLPPALGLLVAAGVAGAALLLVHVRRGHSQDAGSRLLAGTPE PSVHALPDALNNLRTQEGSGDGPSSSVDWNRPEDVDPQGIYVISAPSIYAREVATPLFPP LHTGRAGQRQHLLFPYPSSILSVK |
| 557 | Human DLL3 DSL-EGF6 | METDTLLLWVLLLWVPGSTGYPYDVPDYAGMLGSARCEPPAVGTACTRLCRPRSAPSRCG PGLRPCAPLEDECEAPLVCRAGCSPEHGFCEQPGECRCLEGWTGPLCTVPVSTSSCLSPR GPSSATTGCLVPGPGPCDGNPCANGGSCSETPRSFECTCPRGFYGLRCEVSGVTCADGPC FNGGLCVGGADPDSAYICHCPPGFQGSNCEKRVDRCSLQPCRNGGLCLDLGHALRCRCRA GFAGPRCEHDLDDCAGRACANGGTCVEGGAHRCSCALGFGGRDCRERADPCAARPCAHG GRCYAHFSGLVCACAPGYMGARCEFPVHPDGASALPAAPPGLRPGDPQRYLLPPALGLLV AAGVAGAALLLVHVRRGHSQDAGSRLLAGTPEPSVHALPDALNNLRTQEGSGDGPSSSV DWNRPEDVDPQGIYVISAPSIYAREVATPLFPPLHTGRAGQRQHLLFPYPSSILSVK |
| 558 | Human DLL3 EGF1- EGF6 | METDTLLLWVLLLWVPGSTGYPYDVPDYAGMLGSAPLVCRAGCSPEHGFCEQPGECRCLE GWTGPLCTVPVSTSSCLSPRGPSSATTGCLVPGPGPCDGNPCANGGSCSETPRSFECTCP RGFYGLRCEVSGVTCADGPCFNGGLCVGGADPDSAYICHCPPGFQGSNCEKRVDRCSLQP CRNGGLCLDLGHALRCRCRAGFAGPRCEHDLDDCAGRACANGGTCVEGGAHRCSCALGF GGRDCRERADPCAARPCAHGGRCYAHFSGLVCACAPGYMGARCEFPVHPDGASALPAAPP GLRPGDPQRYLLPPALGLLVAAGVAGAALLLVHVRRGHSQDAGSRLLAGTPEPSVHALP DALNNLRTQEGSGDGPSSSVDWNRPEDVDPQGIYVISAPSIYAREVATPLFPPLHTGRAG QRQHLLFPYPSSILSVK |

FIG. 2C

| SEQ. ID. NO. | Name/Component | Sequence |
|---|---|---|
| 559 | Human DLL3 EGF2- EGF6 | METDTLLLWVLLLWVPGSTGYPYDVPDYAGMLGSSGPGPCDGNPCANGGSCSETPRSFECT CPRGFYGLRCEVSGVTCADGPCFNGGLCVGGADPDSAYICHCPPGFQGSNCEKRVDRCSL QPCRNGGLCLDLGHALRCRCRAGFAGPRCEHDLDDCAGRACANGGTCVEGGAHRCSCAL GFGGRDCRERADPCAARPCAHGGRCYAHFSGLVCACAPGYMGARCEFPVHPDGASALPAA PPGLRPGDPQRYLLPPALGLLVAAGVAGAALLLVHVRRRGHSQDAGSRLLAGTPEPSVHA LPDALNNLRTQEGSGDGPSSSVDWNRPEDVDPQGIYVISAPSIYAREVATPLFPPLHTGR AGQRQHLLFPYPSSILSVK |
| 560 | Human DLL3 EGF3- EGF6 | METDTLLLWVLLLWVPGSTGYPYDVPDYAGMLGSSGVTCADGPCFNGGLCVGGADPDSAY ICHCPPGFQGSNCEKRVDRCSLQPCRNGGLCLDLGHALRCRCRAGFAGPRCEHDLDDCAG RACANGGTCVEGGAHRCSCALPAARPCAHGGRCYAHFSGLVCACAP GYMGARCEFPVHPDGASALPAAPPGLRPGDPQRYLLPPALGLLVAAGVAGAALLLVHVRR RGHSQDAGSRLLAGTPEPSVHALPDALNNLRTQEGSGDGPSSSVDWNRPEDVDPQGIYVI SAPSIYAREVATPLFPPLHTGRAGQRQHLLFPYPSSILSVK |
| 561 | Human DLL3 EGF4- EGF6 | METDTLLLWVLLLWVPGSTGYPYDVPDYAGMLGSRVDRCSLQPCRNGGLCLDLGHALRCR CRAGFAGPRCEHDLDDCAGRACANGGTCVEGGAHRCSCALGFGGRDCRERADPCAARPC AHGGRCYAHFSGLVCACAPGYMGARCEFPVHPDGASALPAAPPGLRPGDPQRYLLPPALG LLVAAGVAGAALLLVHVRRRGHSQDAGSRLLAGTPEPSVHALPDALNNLRTQEGSGDPS SSVDWNRPEDVDPQGIYVISAPSIYAREVATPLFPPLHTGRAGQRQHLLFPYPSSILSVK |
| 562 | Human DLL3 EGF5- EGF6 | METDTLLLWVLLLWVPGSTGYPYDVPDYAGMLGSDLDDCAGRACANGGTCVEGGAHRCS CALGFGGRDCRERADPCAARPCAHGGRCYAHFSGLVCACAPGYMGARCEFPVHPDGASAL PAAPPGLRPGDPQRYLLPPALGLLVAAGVAGAALLLVHVRRRGHSQDAGSRLLAGTPEPS VHALPDALNNLRTQEGSGDGPSSSVDWNRPEDVDPQGIYVISAPSIYAREVATPLFPPLH TGRAGQRQHLLFPYPSSILSVK |
| 563 | Human DLL3 EGF6 | METDTLLLWVLLLWVPGSTGYPYDVPDYAGMLGSRADPCAARPCAHGGRCYAHFSGLVCA CAPGYMGARCEFPVHPDGASALPAAPPGLRPGDPQRYLLPPALGLLVAAGVAGAALLLVH VRRRGHSQDAGSRLLAGTPEPSVHALPDALNNLRTQEGSGDGPSSSVDWNRPEDVDPQGI YVISAPSIYAREVATPLFPPLHTGRAGQRQHLLFPYPSSILSVK |

DLL3 CAR domain structure

FIG. 3C

| Clone | Transduction efficiency (Donor 116) | Transduction efficiency (Donor 117) |
|---|---|---|
| 2A6.C5 | 37.2 % | 37.7 % |
| 2D3 | 46.1 % | 47.4 % |
| 5A2 | 49.1 % | 47.4 % |
| 5C1.A4 | 0.31 % | NA |
| 5E12 | 53.8 % | 49.1 % |
| 6D8 | 32.4 % | 34.8 % |
| 7F9 | 42.2 % | 37.4 % |
| 8E11 | 39.1 % | 41.4 % |
| 9D3 | 52.4 % | 50.8 % |
| 9F7 | 0.24 % | 0.15 % |
| 26C8 | 48.9 % | 46.9 % |

| Clone | Transduction efficiency (Donor 116) | Transduction efficiency (Donor 419) |
|---|---|---|
| 2C3 | 31.0 % | 22.7 % |
| 2G1 | 66.9 % | 49.1 % |
| 3E4 | 58.3 % | 46.4 % |
| 3F2 | 16.3 % | 12.2 % |
| 4F9 | 67.5 % | 49.4 % |
| 4G9 | 48.9 % | 35.2 % |
| 6H1 | 5.81 % | 2.70 % |
| 6H5 | <0.1 % | <0.1 % |
| 10D1 | <0.1 % | <0.1 % |
| 11F6 | 15.2 % | 4.08 % |
| 11H7 | 52.4 % | 40.2 % |
| 16H7 | 42.7 % | 27.1 % |
| 17A2 | 68.6 % | 43.3 % |

FIG. 3D

| Clone | Transduction efficiency (Donor 503) | Transduction efficiency (Donor 772) |
|---|---|---|
| 4H5 | <0.1% | <0.1% |
| 6F8 | 59.4% | 26.7% |
| 3G6 - L1 | 35% | 14.2% |
| 3G6 - L2 | 33.5% | 16.9% |
| 4C6 | 56.9% | 25.2% |
| 3B9 | <0.1% | <0.1% |
| 4E6 | 37.8% | 24.8% |
| 3F9-L | 19.5% | 13.8% |
| 4H8 | 39.3% | 27.2% |
| 3E10 | <0.1% | 0.43% |
| 3C3 | <0.1% | 0.14% |
| 11F4 | <0.1% | 0.43% |
| 9H12-K | 41.4% | 35.6% |
| 10E12 | <0.1% | 0.98% |
| 10G1-K | 53.7% | 33.7% |
| 11A3 | 42.1% | 20% |

| Clone | Transduction efficiency (Donor 419) | Transduction efficiency (Donor 503) |
|---|---|---|
| 3B11 | 57.3% | 65.8% |
| 4E1 | 2.35% | 3.18% |
| 5G2 | 36.7% | 42.8% |
| 2404.6H1 | 6.01% | 6.41% |
| 2A8-K | <0.1% | <0.1% |
| 3B1 | 6.15% | 7.95% |
| 9B5 | <0.1% | <0.1% |
| 11E4 | 54.8% | 62.8% |
| 2404.8E11 | NA | 58.9% |
| 11A5 | NA | 0.11% |
| 10A2 | 58.5% | 67.6% |
| 11A8 | 33.4% | 45.1% |

NA, not available

FIG. 5

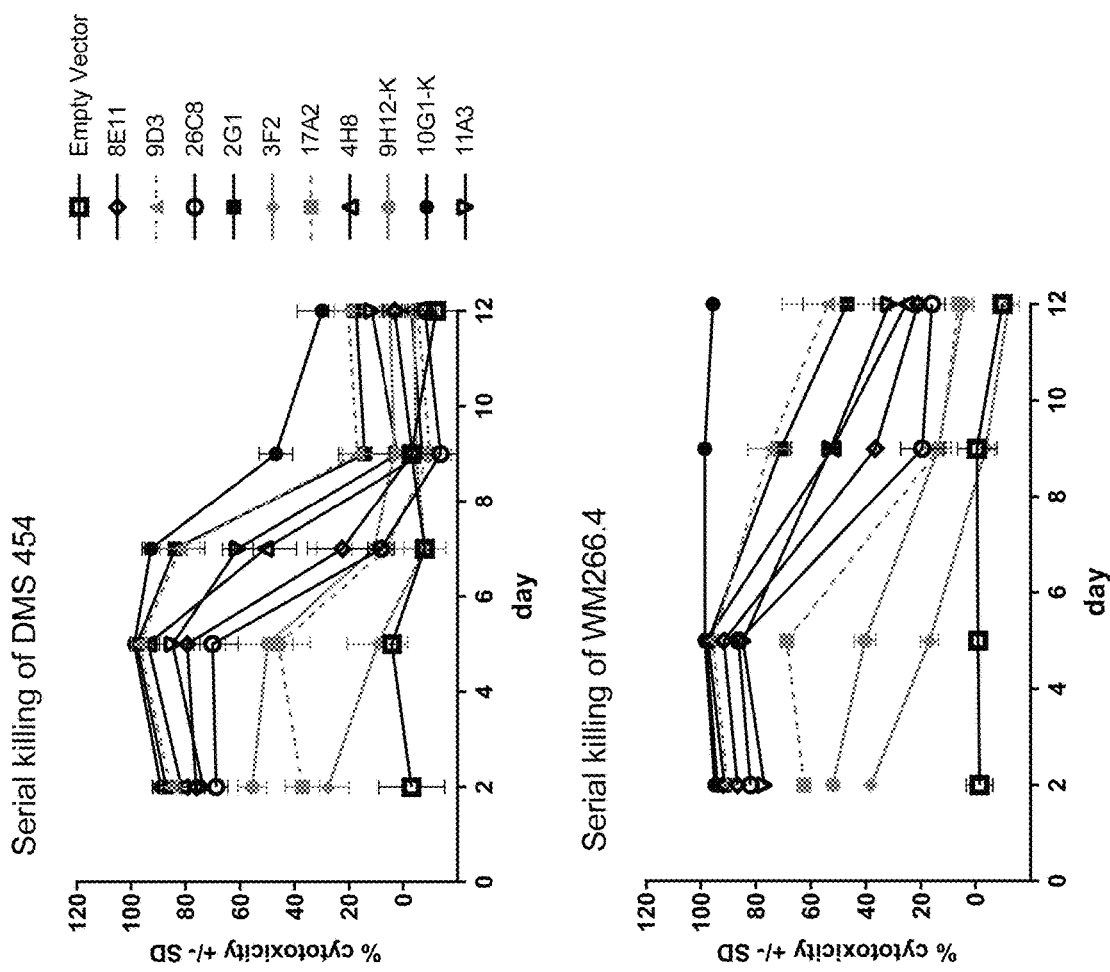

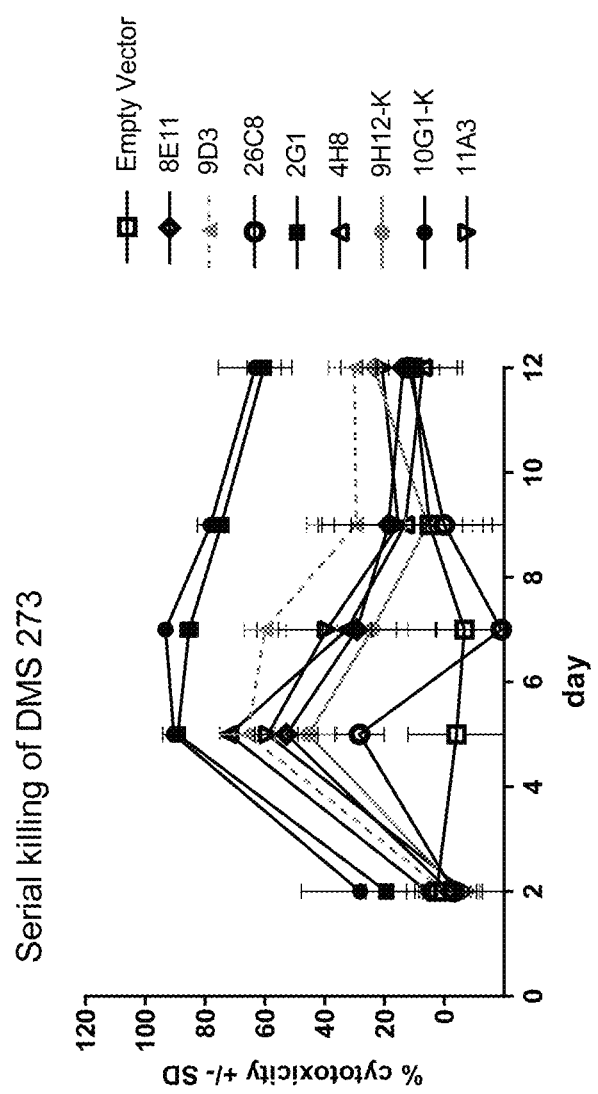

FIG. 14C

Human CD3 Staining Score (Day 49)

| Group | Animal | Brain | Pituitary |
|---|---|---|---|
| Non-transduced T cells | #1 | 1 | 1 |
| | #2 | 1 | 1 |
| | #3 | 1 | 1 |
| DLL3 CAR T | #4 | 2 | 3 |
| | #5 | 1 | 3 |
| | #6 | 1 | 3 |

Staining score:
0 = No staining
1 = Sparse-to-moderately low staining
2 = Moderate-to-moderately high staining
3 = Abundant staining

FIG. 14D

Histopathology Analysis (Day 49)

| Group | Animal | Brain | Pituitary |
|---|---|---|---|
| Non-transduced T cells | #1 | NSML | NSML |
| | #2 | NSML | NSML |
| | #3 | NSML | NSML |
| DLL3 CAR T | #4 | NSML | Infiltrate, mixed cell (severity*=3) |
| | #5 | NSML | Infiltrate, mononuclear cell(severity=2) |
| | #6 | NSML | Infiltrate, mononuclear cell(severity=2) |

NSML=No Significant Microscopic Lesions
*Severity: 1=Minimal; 2=Mild; 3=Moderate

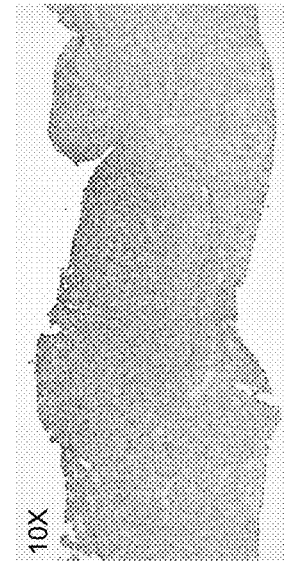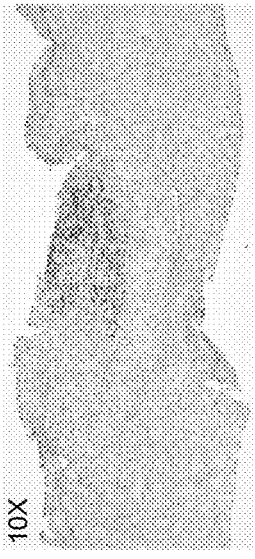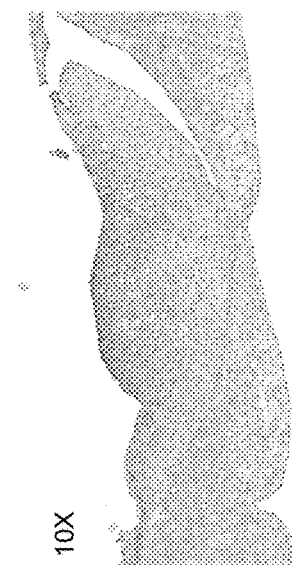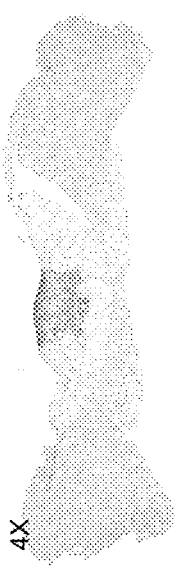
FIG. 14E
FIG. 14F

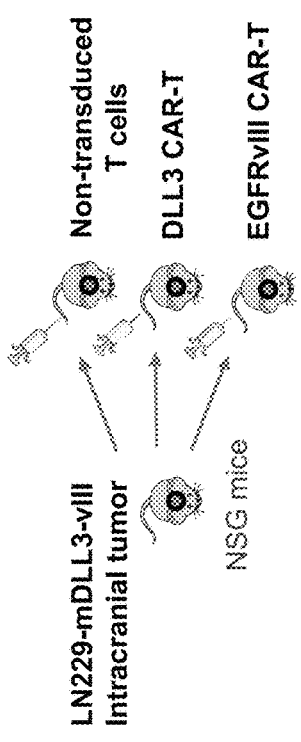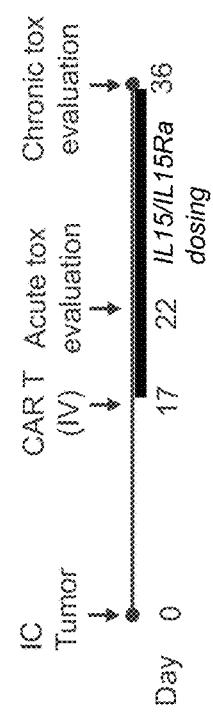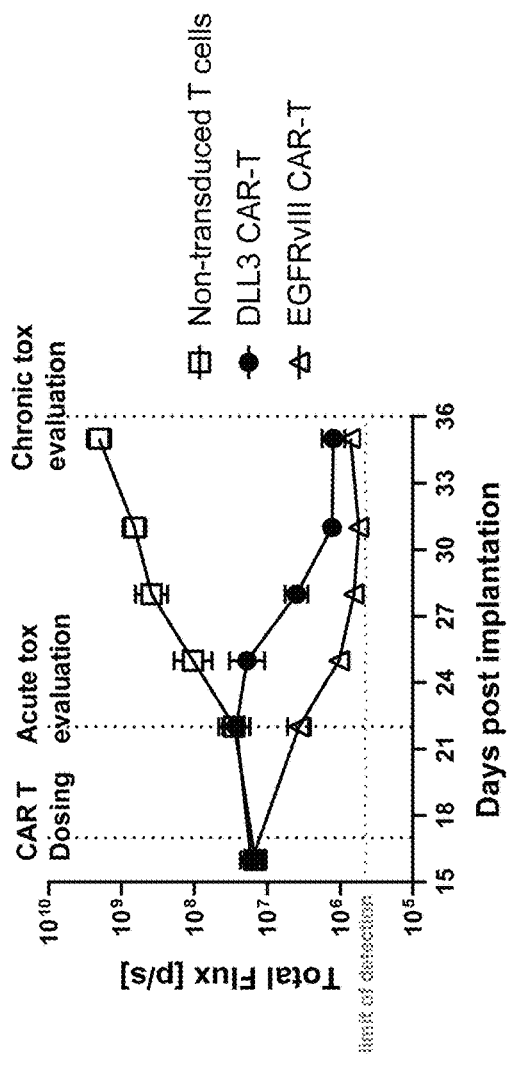
FIG. 15A
FIG. 15B

FIG. 15C

Human CD45 Staining Score (Day 36 or 38)

| Group | Animal | Brain | Pituitary | Spleen |
|---|---|---|---|---|
| Non-transduced T cells | #1 | 1 | 1 | 3 |
| | #2 | 1 | 1 | 3 |
| | #3 | 1 | 1 | 3 |
| | #4 | 1 | 1 | 3 |
| | #5 | 1 | 1 | 3 |
| DLL3 CAR T | #6 | 1 | 2 | 3 |
| | #7 | 1/2 | 1/2 | 3 |
| | #8 | 1 | 1/2 | 3 |
| | #9 | 1 | 1/2 | 3 |
| | #10 | 1 | 1/2 | 2 |
| EGFRvIII CAR T | #11 | 1 | 1 | 2 |
| | #12 | 1 | 1 | 3 |
| | #13 | 1 | 1 | 2 |
| | #14 | 1 | 1 | 3 |
| | #15 | 1 | 1 | 3 | hCD45 Staining score:
0 = No staining
1 = Rare/Sparse staining
2 = Sparse-to-moderately low staining
3 = Moderate-to-moderately high staining
4 = Abundant staining

FIG. 15D

Histopathology Analysis (Day 36 or 38)

| Group | Animal | Brain | Pituitary |
|---|---|---|---|
| Non-transduced T cells | #1 | NSML | NSML |
| | #2 | Tumor present | NSML |
| | #3 | Tumor present | NSML |
| | #4 | Tumor present | NSML |
| | #5 | Tumor present | NSML |
| DLL3 CAR T | #6 | Tumor present | Infiltrate, mononuclear cell (severity=2) |
| | #7 | Tumor present | Infiltrate, mononuclear cell (severity=2) |
| | #8 | Tumor present | Infiltrate, mononuclear cell (severity=1) |
| | #9 | NSML | Infiltrate, mononuclear cell (severity=2) |
| | #10 | NSML | Infiltrate, mononuclear cell (severity=2) |
| EGFRvIII CAR T | #11 | NSML | NSML |
| | #12 | NSML | NSML |
| | #13 | NSML | NSML |
| | #14 | NSML | NSML |
| | #15 | NSML | NSML |

NSML=No Significant Microscopic Lesions
**Severity: 1=Minimal; 2=Mild; 3=Moderate

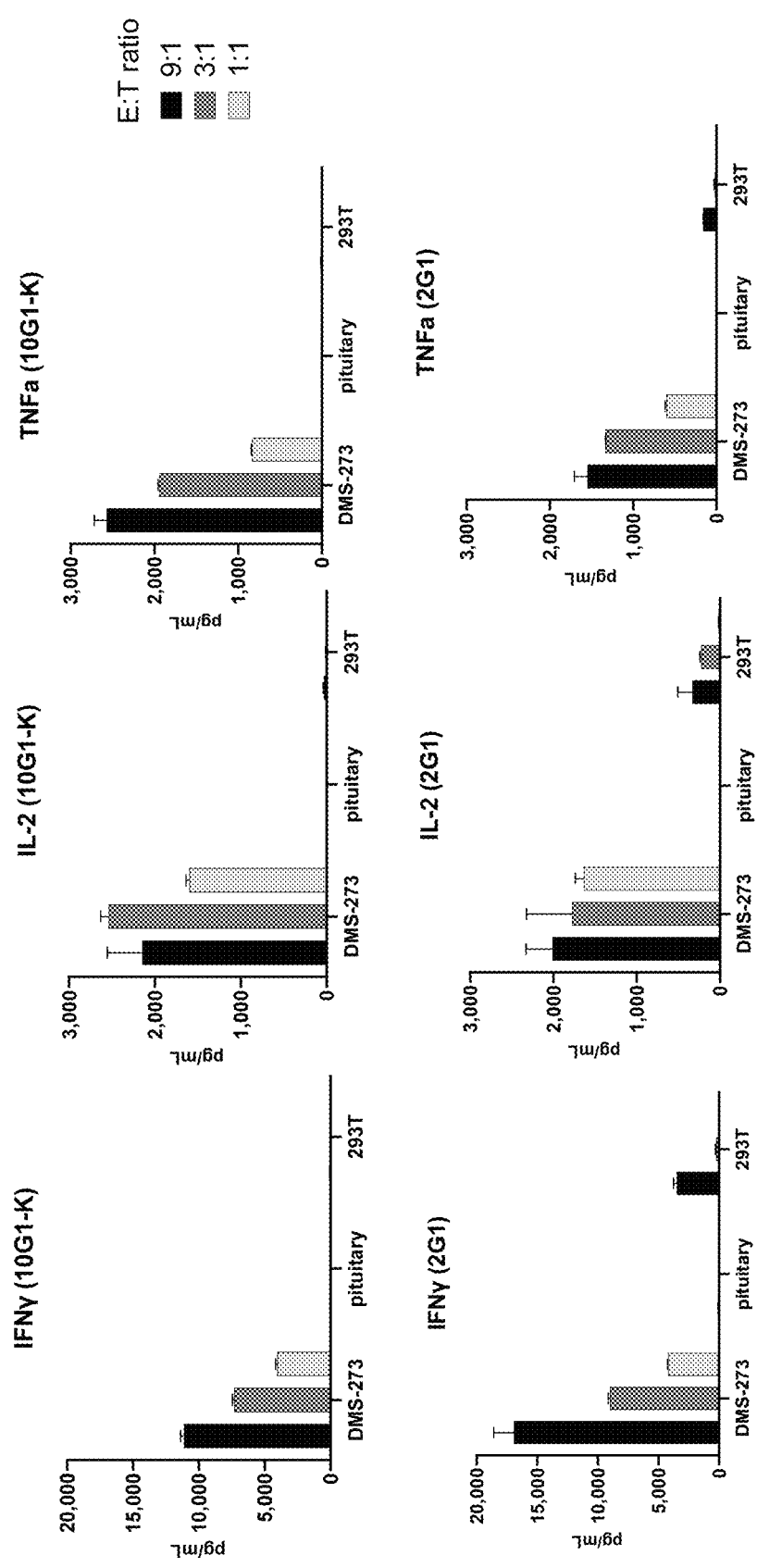

DLL3 TARGETING CHIMERIC ANTIGEN RECEPTORS AND BINDING AGENTS

CROSS REFERENCE TO RELATED APPLICATIONS

The present application claims the benefit of priority to U.S. Provisional Application No. 62/812,585, filed Mar. 1, 2019; and U.S. Provisional Application No. 62/969,976, filed Feb. 4, 2020, the contents of all of which are hereby incorporated by reference in their entireties.

FIELD

This disclosure relates to DLL3 binding agents and chimeric antigen receptors (CARs) comprising an antigen binding molecule which binds to DLL3, polynucleotides encoding the same, and methods of treating a cancer in a patient using the same.

SEQUENCE LISTING

This application is being filed electronically via EFS-Web and includes an electronically submitted sequence listing in .txt format. The .txt file contains a sequence listing entitled "AT-019_03 US_SL" created on Feb. 4, 2020, and having a size of 1,026,798 bytes. The sequence listing contained in this .txt file is part of the specification and is incorporated herein by reference in its entirety.

BACKGROUND

Small cell lung cancer (SCLC) is an aggressive form of lung cancer with a poor prognosis and limited therapeutic options. SCLC represents about 10-15% of all new diagnosed lung cancers. The American Cancer Society estimates that about 234,000 new cases of lung cancer will be diagnosed in 2018. Estimated 5-year relative survival rates for SCLC are 31% (for stage I), 19% (for stage II), 8% (for stage III) and 2% (for stage IV). Survival rates for SCLC have remained low for several decades in a large part due to the lack of new therapies to combat this form of lung cancer. Conventional therapeutic treatments for cancer include chemotherapy and radiotherapy. Patients typically respond well to the current front-line therapy, which includes etoposide and cisplatin, but invariably quickly relapse with chemoresistant disease. Prognosis in the relapsed refractory setting is extremely poor, with rapid disease progression and short median survival of less than six months. There remains therefore a great need to develop more targeted and potent therapies for proliferative disorders.

Adoptive transfer of immune cells genetically modified to recognize malignancy-associated antigens is showing promise as a new approach to treating cancer (see, e.g., Brenner et al., Current Opinion in Immunology, 22(2): 251-257 (2010); Rosenberg et al., Nature Reviews Cancer, 8(4): 299-308 (2008)) Immune cells can be genetically modified to express chimeric antigen receptors (CARs), fusion proteins comprised of a DLL3 antigen recognition moiety and T cell activation domains (see, e.g., Eshhar et al., Proc. Natl. Acad. Sci. USA, 90(2): 720-724 (1993), and Sadelain et al., Curr. Opin. Immunol, 21(2): 215-223 (2009)) Immune cells that contain CARs, e.g., CAR-T cells (CAR-Ts), are engineered to endow them with antigen specificity while retaining or enhancing their ability to recognize and kill a target cell.

DLL3 is a non-canonical Notch ligand, functioning in a cell autonomous manner to inhibit Notch signaling, thus blocking cell to cell interactions and internalization of Notch in the target cell. Delta-like ligand 3 (DLL3) is an SCLC tumor marker and has been found to be associated with cancer stem cells. Other indications that implicate DLL3 include melanoma, low grade gliomas, glioblastoma, medullary thyroid cancer, carcinoids, dispersed neuroendocrine tumors in the pancreas, bladder and prostate, testicular cancer, and lung adenocarcinomas with neuroendocrine features. There is a need for treatments for cancer and in particular malignancies involving aberrant expression of DLL3. Provided herein are methods and compositions addressing this need.

SUMMARY

Provided herein are chimeric antigen receptors (CARs) comprising a DLL3 antigen binding domain that specifically binds to DLL3; and immune cells comprising these DLL3-specific CARs, e.g., CAR-T cells. Also provided are methods of making and using these DLL3-specific CARs, and immune cells comprising these DLL3-specific CARs. The DLL-3 targeting CAR T cells described herein demonstrate good transduction efficiency, in vitro phenotype and potent in vitro and in vivo anti-tumor activity.

In one aspect, the present disclosure provides a chimeric antigen receptor comprising an extracellular domain, a transmembrane domain, and an intracellular domain, wherein the extracellular domain comprises a DLL3 antigen binding domain that specifically binds to DLL3, and wherein the antigen binding domain comprises at least one of: (a) a variable heavy chain CDR1 comprising an amino acid sequence selected from the group consisting of SEQ ID NOs 1, 10, 19, 28, 37, 46, 55, 64, 73, 82, 91, 100, 109, 118, 127, 136, 145, 154, 163, 172, 181, 190, 199, 208, 217, 226, 235, 244, 253, 262, 271, 280, 289, 298, 307, 316, 325, 334, 343, 352, 361, 370, 379, 388, 397, 406, 415, 424, 433, 442, 451, and 460; (b) a variable heavy chain CDR2 comprising an amino acid sequence selected from the group consisting of SEQ NOs: 2, 11, 20, 38, 47, 56, 65, 74, 83, 92, 101, 110, 119, 128, 137, 146, 155, 164, 173, 182, 191, 200, 209, 218, 227, 236, 245, 254, 263, 272, 281, 290, 299, 308, 317, 326, 335, 344, 353, 362, 371, 380, 389, 398, 407, 416, 425, 434, 443, 452, 461, and 695; (c) a variable heavy chain CDR3 comprising an amino acid sequence selected from the group consisting of SEQ ID NOs 3, 12, 21, 30, 39, 48, 57, 66, 75, 84, 93, 102, 111, 120, 129, 138, 147, 156, 165, 174, 183, 192, 201, 210, 219, 228, 237, 246, 255, 264, 273, 282, 291, 300, 309, 318, 327, 336, 345, 354, 363, 372, 381, 390, 399, 408, 417, 426, 435, 444, 453, and 462; (d) a variable light chain CDR1 comprising an amino acid sequence selected from the group consisting of SEQ ID NOs: 4, 13, 22, 31, 40, 49, 58, 67, 85, 94, 103, 112, 121, 130, 139, 148, 157, 166, 175, 184, 193, 202, 211, 220, 229, 238, 247, 256, 265, 274, 283, 292, 301, 310, 319, 328, 337, 346, 355, 364, 373, 382, 391, 400, 409, 418, 427, 436, 445, 454, 463, and 696; (e) a variable light chain CDR2 comprising an amino acid sequence selected from the group consisting of SEQ ID NOs: 5, 14, 23, 32, 41, 50, 59, 68, 77, 86, 95, 104, 113, 122, 131, 140, 149, 158, 167, 176, 185, 194, 203, 212, 221, 230, 239, 248, 257, 266, 275, 284, 293, 302, 311, 320, 329, 338, 347, 356, 365, 374, 383, 392, 401, 410, 419, 428, 437, 446, 455, and 464; and (f) a variable light chain CDR3 comprising an amino acid sequence selected from the group consisting of SEQ ID NOs: 6, 15, 24, 33, 42, 51, 60, 69, 78, 87, 96, 105, 114, 123, 132, 141, 150, 159, 168, 177, 186, 195, 204, 213, 222, 231, 240, 249, 258, 267, 276, 285, 294, 303, 312, 321, 330, 339, 348, 357, 366, 375, 384, 393, 402, 411, 420, 429, 438, 447, 456, and 465.

In another aspect, the present disclosure provides a chimeric antigen receptor comprising an extracellular domain, a transmembrane domain, and an intracellular domain, wherein the extracellular domain comprises a DLL3 antigen binding domain that specifically binds to DLL3, and wherein the antigen binding domain comprises: (a) a variable heavy chain CDR1 comprising an amino acid sequence selected from the group consisting of SEQ ID NOs: 1, 10, 19, 28, 37, 46, 55, 64, 73, 82, 91, 100, 109, 118, 127, 136, 145, 154, 163, 172, 181, 190, 199, 208, 217, 226, 235, 244, 253, 262, 271, 280, 289, 298, 307, 316, 325, 334, 343, 352, 361, 370, 379, 388, 397, 406, 415, 424, 433, 442, 451, and 460; (b) a variable heavy chain CDR2 comprising an amino acid sequence selected from the group consisting of SEQ NOs: 2, 11, 20, 38, 47, 56, 65, 74, 83, 92, 101, 110, 119, 128, 137, 146, 155, 164, 173, 182, 191, 200, 209, 218, 227, 236, 245, 254, 263, 272, 281, 290, 299, 308, 317, 326, 335, 344, 353, 362, 371, 380, 389, 398, 407, 416, 425, 434, 443, 452, and 695461; and (c) a variable heavy chain CDR3 comprising an amino acid sequence selected from the group consisting of SEQ ID NOs: 3, 12, 21, 30, 39, 48, 57, 66, 75, 84, 93, 102, 111, 120, 129, 138, 147, 156, 165, 174, 183, 192, 201, 210, 219, 228, 237, 246, 255, 264, 273, 282, 291, 300, 309, 318, 327, 336, 345, 354, 363, 372, 381, 390, 399, 408, 417, 426, 435, 444, 453, and 462.

In one aspect, the present disclosure provides a chimeric antigen receptor comprising an extracellular domain, a transmembrane domain, and an intracellular domain, wherein the extracellular domain comprises a DLL3 antigen binding domain that specifically binds to DLL3, and wherein the antigen binding domain comprises: (a) a variable light chain CDR1 comprising an amino acid sequence selected from the group consisting of SEQ ID NOs: 4, 13, 22, 31, 40, 49, 58, 67, 85, 94, 103, 112, 121, 130, 139, 148, 157, 166, 175, 184, 193, 202, 211, 220, 229, 238, 247, 256, 265, 274, 283, 292, 301, 310, 319, 328, 337, 346, 355, 364, 373, 382, 391, 400, 409, 418, 427, 436, 445, 454, 463, and 696; (b) a variable light chain CDR2 comprising an amino acid sequence selected from the group consisting of SEQ NOs: 5, 14, 23, 32, 41, 50, 59, 68, 77, 86, 95, 104, 113, 122, 131, 140, 149, 158, 167, 176, 185, 194, 203, 212, 221, 230, 239, 248, 257, 266, 275, 284, 293, 302, 311, 320, 329, 338, 347, 356, 365, 374, 383, 392, 401, 410, 419, 428, 437, 446, 455, and 464; and (c) a variable light chain CDR3 comprising an amino acid sequence selected from the group consisting of SEQ ID NOs: 6, 15, 24, 33, 42, 51, 60, 69, 78, 87, 96, 105, 114, 123, 132, 141, 150, 159, 168, 177, 186, 195, 204, 213, 222, 231, 240, 249, 258, 267, 276, 285, 294, 303, 312, 321, 330, 339, 348, 357, 366, 375, 384, 393, 402, 411, 420, 429, 438, 447, 456, and 465.

In another aspect, the present disclosure provides a chimeric antigen receptor comprising an extracellular domain, a transmembrane domain, and an intracellular domain, wherein the extracellular domain comprises a DLL3 antigen binding domain that specifically binds to DLL3, and wherein the antigen binding domain comprises at least one of: (a) a variable heavy chain comprising an amino acid sequence selected from the group consisting of SEQ ID NOs: 7, 16, 25, 34, 43, 52, 61, 70, 79, 88, 97, 106, 115, 124, 133, 142, 151, 160, 169, 178, 187, 196, 205, 214, 223, 232, 241, 250, 259, 268, 277, 286, 295, 304, 313, 322, 331, 340, 349, 358, 367, 376, 385, 394, 403, 412, 421, 430, 439, 448, 457, 466; and (b) a variable light chain comprising an amino acid sequence selected from the group consisting of SEQ NOs: 8, 17, 26, 35, 44, 53, 62, 71, 80, 89, 98, 107, 116, 125, 134, 143, 152, 161, 170, 179, 188, 197, 206, 215, 224, 233, 242, 251, 260, 269, 278, 287, 296, 305, 314, 323, 332, 341, 350, 359, 368, 377, 386, 395, 404, 413, 422, 431, 440, 449, 458, and 467, wherein the variable heavy chain and the variable light chain is linked by at least one linker.

In a further aspect, the present disclosure provides a chimeric antigen receptor comprising an extracellular domain, a transmembrane domain, and an intracellular domain, wherein the extracellular domain comprises a DLL3 antigen binding domain that specifically binds to DLL3, and wherein the antigen binding domain comprises: (a) a variable heavy chain comprising an amino acid sequence selected from the group consisting of SEQ ID NOs: 7, 16, 25, 34, 43, 52, 61, 70, 79, 88, 97, 106, 115, 124, 133, 142, 151, 160, 169, 178, 187, 196, 205, 214, 223, 232, 241, 250, 259, 268, 277, 286, 295, 304, 313, 322, 331, 340, 349, 358, 367, 376, 385, 394, 403, 412, 421, 430, 439, 448, 457, and 466; and (b) a variable light chain comprising an amino acid sequence selected from the group consisting of SEQ NOs: 8, 17, 26, 35, 44, 53, 62, 71, 80, 89, 98, 107, 116, 125, 134, 143, 152, 161, 170, 179, 188, 197, 206, 215, 224, 233, 242, 251, 260, 269, 278, 287, 296, 305, 314, 323, 332, 341, 350, 359, 368, 377, 386, 395, 404, 413, 422, 431, 440, 449, 458, and 467, wherein the variable heavy chain and the variable light chain is linked by at least one linker.

In one aspect, the present disclosure provides a chimeric antigen receptor comprising an extracellular domain, a transmembrane domain, and an intracellular domain, wherein the extracellular domain comprises a DLL3 antigen binding domain that specifically binds to DLL3, and wherein the antigen binding domain comprises a sequence selected from the group consisting of those scFvs presented in Table 1d.

In another aspect, the present disclosure provides, a chimeric antigen receptor that specifically binds to DLL3, wherein the chimeric antigen receptor comprises an amino acid sequence that is at least about 80%, 85%, 90%, 95%, 96%, 98%, 99% or 100% identical to any one of SEQ ID NOs: 482 to 533 and 632-683. In some embodiments, the chimeric antigen receptor comprises an amino acid sequence of any one of SEQ ID NOs: 482 to 533 and 632-683.

In some embodiments, the present disclosure provides, a chimeric antigen receptor that specifically binds to DLL3, wherein the chimeric antigen receptor comprises an amino acid sequence that is at least about 80%, 85%, 90%, 95%, 96%, 98%, 99% or 100% identical to any one of SEQ ID NOs: 482 to 533 and 632-683, with or without a signal sequence. In some embodiments, the chimeric antigen receptor comprises an amino acid sequence of any one of SEQ ID NOs: 482 to 533 and 632-683, with or without a signal sequence.

In some embodiments, the intracellular domain of the chimeric antigen receptor comprises at least one costimulatory domain.

In some embodiments, the costimulatory domain of the chimeric antigen receptor is a signaling region of CD28, OX-40, 4-1BB/CD137, CD2, CD7, CD27, CD30, CD40, programmed death-1 (PD-1), inducible T cell costimulator (ICOS), lymphocyte function-associated antigen-1 (LFA-1 (CD1 1a/CD18), CD3 gamma, CD3 delta, CD3 epsilon, CD247, CD276 (B7-H3), LIGHT, (TNFSF14), NKG2C, Ig alpha (CD79a), DAP-10, Fc gamma receptor, MHC class I molecule, TNF receptor proteins, an Immunoglobulin protein, cytokine receptor, integrins, Signaling Lymphocytic Activation Molecules (SLAM proteins), activating NK cell receptors, BTLA, a Toll ligand receptors, ICAM-1, B7-H3, CDS, ICAM-1, GITR, BAFFR, LIGHT, HVEM (LIGHTR), KIRDS2, SLAMF7, NKp80 (KLRF1), NKp44, NKp30, NKp46, CD19, CD4, CD8alpha, CD8beta, IL-2R beta, IL-2R gamma, IL-7R alpha, ITGA4, VLA1, CD49a, ITGA4, CD49D, ITGA6, VLA-6, CD49f, ITGAD, CD1 1d, ITGAE, CD103, ITGAL, CD1 1a, LFA-1, ITGAM, CD1 1b, ITGAX, CD1 1c, ITGB1, CD29, ITGB2, CD18, LFA-1, ITGB7, NKG2D, TNFR2, TRANCE/RANKL, DNAMI (CD226), SLAMF4 (CD244, 2B4), CD84, CD96 (Tactile), CEACAM1, CRT AM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, CD19a, a ligand that specifically binds with CD83, or any combination thereof.

In some embodiments, the costimulatory domain comprises a signaling region of CD28.

In some embodiments, the CD28 costimulatory domain comprises SEQ ID NO: 550.

In some embodiments, the costimulatory domain comprises a signaling region of 4-1BB/CD137.

In some embodiments, the 4-1BB/CD137 costimulatory domain comprises SEQ ID NO: 480.

In some embodiments, the intracellular domain comprises at least one activating domain.

In some embodiments, the activating domain comprises CD3.

In some embodiments, the CD3 comprises CD3 zeta.

In some embodiments, the CD3 zeta comprises SEQ ID NO: 481.

In some embodiments, the chimeric antigen receptor is encoded by the polynucleotide sequence of any one of SEQ ID NOs: 571-621 and 631.

In some embodiments, the chimeric antigen receptor further comprises a safety switch.

In some embodiments, the safety switch comprises a CD20 mimotope or a QBEND-10 epitope.

In some embodiments, the safety switch comprises one or more CD20 mimotopes or one or more QBEND-10 epitopes, or combinations thereof.

In some embodiments, the chimeric antigen receptor comprises one or more safety switch in the format of QR3, SR2, RSR, or R2S.

In some embodiments, the chimeric antigen receptor comprises the amino acid sequence that is at least about 80%, 85%, 90%, 95%, 96%, 98%, 99% or 100% identical to any one of SEQ ID NOs: 622-628, 474-476, 565, and 684-694.

In some embodiments, the chimeric antigen receptor comprises the amino acid sequence that is at least about 80%, 85%, 90%, 95%, 96%, 98%, 99% or 100% identical to any one of SEQ ID NOs: 622-628, 474-476, 565, and 684-694, with or without a signal sequence.

In some aspects, the present disclosure provides an isolated polynucleotide encoding any one of the chimeric antigen receptors described herein.

In another aspect, the present disclosure provides a vector comprising the polynucleotide encoding any one of the chimeric antigen receptors described herein.

In some embodiments, the vector is a retroviral vector, a DNA vector, a plasmid, a RNA vector, an adenoviral vector, an adenovirus associated vector, a lentiviral vector, or any combination thereof.

In another aspect, the present disclosure provides an engineered immune cell expressing any chimeric antigen receptors described herein.

In some aspects, the present disclosure provides an engineered immune cell expressing the polynucleotide or vector encoding any one of the chimeric antigen receptors described herein.

In some embodiments, the engineered immune cell is a T cell, tumor infiltrating lymphocyte (TIL), NK cell, TCR-expressing cell, dendritic cell, or NK-T cell.

In some embodiments, the engineered immune cell is an autologous T cell.

In some embodiments, the engineered immune cell is an allogeneic T cell.

In some embodiments, the engineered immune cell is TCR (e.g., TCRα, TCRβ) knocked out.

In one aspect, the present disclosure provides a pharmaceutical composition comprising the engineered immune cell expressing a chimeric antigen receptors described herein.

In some aspects, the present disclosure provides a method of treating a disease or disorder in a subject in need thereof comprising administering to the subject the engineered immune cell or the pharmaceutical composition comprising the engineered immune cell expressing a chimeric antigen receptors described herein.

In some embodiments, the disease or disorder is cancer.

In some embodiments, the disease or disorder is small cell lung cancer.

In some aspects, the present disclosure provides an article of manufacture comprising the engineered immune cell or the pharmaceutical composition comprising the engineered immune cell expressing a chimeric antigen receptors described herein.

In some aspects, the present disclosure provides an anti-DLL3 binding agent disclosed herein.

In some embodiments, the anti-DLL3 binding agent is an antibody, an antibody conjugate, or an antigen-binding fragment thereof, optionally, a F(ab')2 fragment, a Fab' fragment, a Fab fragment, a Fv fragment, a scFv fragment, a dsFv fragment, or a dAb fragment.

In some embodiments, the binding agent is a monoclonal antibody comprising an IgG constant region.

In some embodiments, the anti-DLL3 binding agent comprises a variable heavy (VH) chain sequence that is at least about 80%, 85%, 90%, 95%, 96%, 98%, 99% or 100% identical to a VH sequence provided in Table 1b.

In some embodiments, the anti-DLL3 binding agent comprises a variable light (VL) chain sequence that is at least about 80%, 85%, 90%, 95%, 96%, 98%, 99% or 100% identical to a VL sequence provided in Table 1c.

In some embodiments, the anti-DLL3 binding agent comprises a sequence that is at least about 80%, 85%, 90%, 95%, 96%, 98%, 99% or 100% identical to an scFv sequence presented in Table 1d.

In some embodiments, the anti-DLL3 binding agent is a fusion protein comprising a scFv fragment fused to an Fc constant region.

In some aspects, the present disclosure provides a pharmaceutical composition comprising the anti-DLL3 binding agent disclosed herein and a pharmaceutically acceptable excipient.

In some aspects, the present disclosure provides a method of treating a disease or disorder in a subject in need thereof comprising administering to the subject an anti-DLL3 binding agent, or a pharmaceutical composition comprising the anti-DLL3 binding agent, as disclosed herein.

In some embodiments, the disease or disorder is cancer.

In some embodiments, the disease or disorder is small cell lung cancer.

BRIEF DESCRIPTION OF THE DRAWINGS

FIGS. 1A-1B are a series of plots showing that purified anti-DLL3 antibodies described herein bind to three DLL3-expressing small cell lung cancer cell lines (SHP-77, DMS 273 and DMS 454). The solid line and dashed line represent staining with anti-DLL3 antibodies or mouse IgG2A isotype control antibody, respectively.

FIGS. 2A-2D show the results of epitope mapping experiments. FIG. 2A is a schematic representation of full length and truncated human DLL3 proteins expressed on CHO cells for epitope mapping, and all the proteins were fused at N-terminus with an HA tag for easy detection.

FIGS. 2B and 2C show the amino acid sequences of full length and truncated human DLL3 proteins shown in FIG. 2A. FIG. 2D is a series of plots showing the results of epitope mapping of anti-DLL3 antibodies, and examples of anti-DLL3 antibodies recognizing DSL, EGF1 and EGF3 domain, respectively; the x-axis depicts signals from PE channel and the y-axis depicts counts.

FIGS. 3A-3C are a series of plots and tables showing the structure, transduction efficiency of cells from two different donors and the cytotoxic activity of anti-DLL3 CARs. FIG. 3A is a schematic of a construct encoding an anti-DLL3 CAR comprising, from the N-terminus to the C-terminus: anti-DLL3 scFv, the hinge and transmembrane regions from human CD8a, the cytoplasmic region from human 41BB and the cytoplasmic region from human CD3. FIG. 3B depicts experimental data showing that anti-DLL3 CARs are expressed on the surface of primary T-cells and can recognize recombinant DLL3; the plots are gated on live CD3+ cells and the numbers on the plots are the percentage of cells expressing each anti-DLL3 CAR. FIGS. 3C and 3D show the transduction efficiency of anti-DLL3 CARs comprising the scFv sequences described herein.

FIG. 4A depicts experimental data showing that anti-DLL3 CAR-T cells specifically killed HEK-293T cells expressing human DLL3 but not parental HEK-293T cells in a 3-day cytotoxicity assay at the indicated effector:target (E:T) ratios. T cells that did not express anti-DLL3 CARs (labelled "empty vector") were used as negative control. FIG. 4B depicts experimental data showing that anti-DLL3 CAR-T cells killed SHP-77 and WM266.4 cells that express endogenous DLL3 in a 3-day cytotoxicity assay at indicated effector:target ratios. FIG. 4C depicts experimental data showing that anti-DLL3 CAR-T cells killed DMS 454 and DMS 273 small cell lung cancer cells that express endogenous DLL3 in a 3-day cytotox assay at indicated effector:target ratios. For all plots in FIGS. 4A-4C, One-glo assay system was used to assess target cell viability, n=3.

FIG. 5 is a series of bar graphs showing that anti-DLL3 CAR-T cells released cytokines after co-incubation with DLL3-expressing SHP-77 cell line when CAR-T cells and SHP-77 cells were incubated at 1:1 or 1:9 effector:target ratio for 24 hours. Supernatant was collected and IFN-γ, IL-2 and TNF-α levels were measured using proinflammory 9-plex kit from MSD, n=3.

FIGS. 6A-6B are plots showing experimental data of a serial killing assay after repeated exposure of anti-DLL3 CAR-T cells to DLL3+ cell lines. FIG. 6A depicts serial killing of anti-DLL3 CAR-T cells to DLL3+WM266.4 cells. Some of the clones remained active on day 12 of the assay. FIG. 6B depicts serial killing of anti-DLL3 CAR-T cells to DMS 454 and WM266.4 cells.

FIG. 6C depicts serial killing of anti-DLL3 CAR-Ts to DMS 273 small cell lung cancer line. For all plots in FIGS. 6A-6C, one-glo assay or CellTiter-glo system was used to assess target cell viability, n=3-5.

FIG. 9A are schematics showing the structure of CAR designs with 4 different safety switches (QR3, SR2, RSR and R2S). FIG. 9B shows flow cytometry plots demonstrating that anti-DLL3 CARs with safety switches shown in FIG. 9A are expressed on the surface of primary T-cells and can recognize recombinant DLL3. The plots are gated on live CD3+ cells and the numbers on the plots indicate the percentage of cells expressing each anti-DLL3 CAR. FIG. 9C depicts experimental data showing that anti-DLL3 CARs with safety switches are active in serial killing assay.

FIG. 11A shows 8E11-SR2 and 26C8-R2S anti-DLL3 CAR-T cells were stained with recombinant DLL3 and PE conjugated rituximab 14 days after expansion and analyzed using flow cytometry. Numbers in quadrants represent percentage of total T cells. FIG. 11B shows rituximab-mediated complement dependent cytotoxicity (CDC) of 8E11-SR2 and 26C8-R2S anti-DLL3 CAR-T cells. CAR-T cells were incubated for 3 hours with 25% baby rabbit complement and rituximab and cytotoxicity was assessed using flow cytometry.

FIG. 12A shows DLL3 CAR-T cells with safety switches eliminated established SHP-77 small cell lung cancer subcutaneous tumors in mice. FIG. 12B is a plot demonstrating that anti-DLL3 CAR-T cells inhibited the growth of IV injected DMS 273-DLL3 small cell lung cancer tumors.

FIGS. 14A-14F show the experimental design and results of a mouse safety study using subcutaneous LN229-mDLL3 tumor model. FIG. 14A shows the study groups and experiment design. FIG. 14B shows the timing of tissue harvest and tumor volume of animals that received either non-transduced T cells or DLL3 CAR-T cells. FIG. 14C is a table showing the human CD3 staining score of brain and pituitary samples. FIG. 14D is a table showing the histology analysis of harvested brain and pituitary samples. FIG. 14E shows images of pituitary samples stained with anti-vasopressin antibody. FIG. 14F shows images of pituitary samples stained with anti-oxytocin antibody.

FIGS. 15A-15D show the experimental design and results of a mouse safety study using intracranial LN229-mDLL3 tumor model. FIG. 15A shows the study groups and experiment design. FIG. 15B shows the timing of tissue harvest and tumor volume of animals that received non-transduced T cells, DLL3 CAR-T cells or EGFRvIII CAR-T cells. FIG. 15C is a table showing the human CD45 staining score of brain, pituitary and spleen samples. FIG. 15D is a table showing the histology analysis of brain and pituitary samples.

FIGS. 16A-16C show the experimental data of the in vitro cytotoxicity of dissociated mouse pituitary cells. FIG. 16A shows the cytotoxicity readout of the target cells after 3-day of co-culture with DLL3 CAR-T cells, demonstrating that DLL3 CARTs are not cytotoxic against mouse pituitary cells in vitro. FIG. 16B shows the flow cytometry analysis of the surface staining for activation markers CD25 and 41BB of the T cells co-cultured with the targets, demonstrating that mouse pituitary cells do not activate DLL3 CAR-Ts in vitro. FIG. 16C shows the cytokines secreted in the cell culture medium, analyzed by MSD, demonstrating that no cytokines are secreted after co-culturing DLL3 CAR-T cells with mouse pituitary cells in vitro for 3 days

DETAILED DESCRIPTION

Figure 1A:
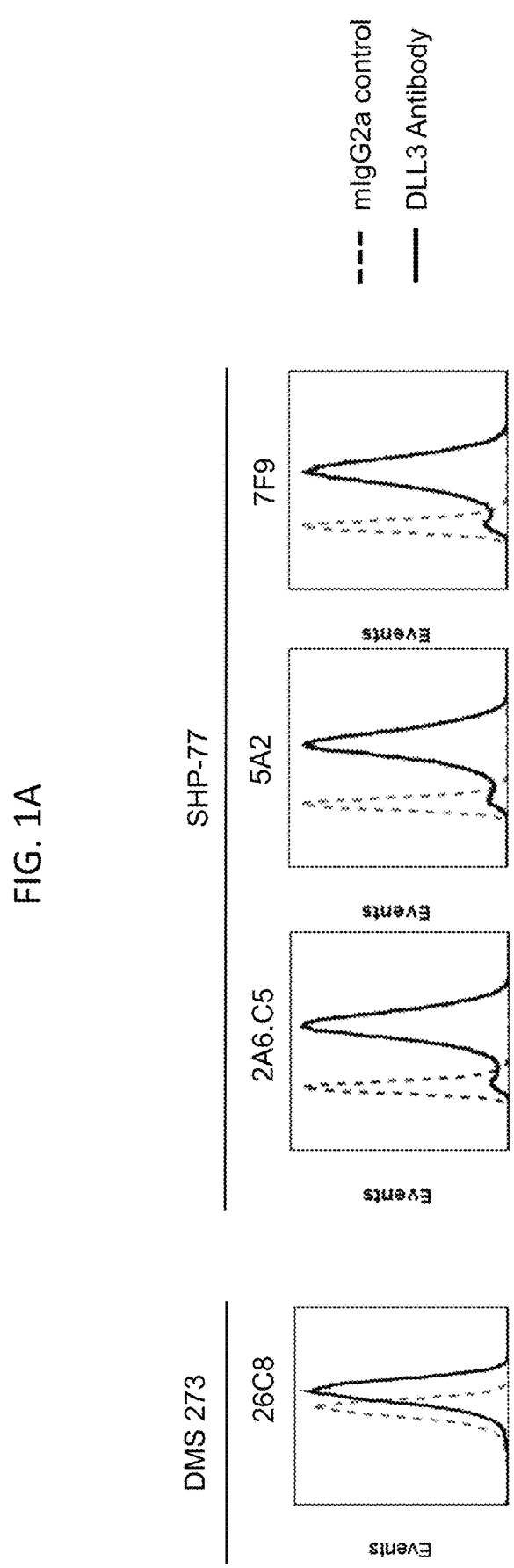

Provided herein are DLL3-specific antibodies and chimeric antigen receptors (CARs). The DLL-3 specific CARs described herein, comprise an extracellular domain, a transmembrane domain, and an intracellular domain, wherein the extracellular domain comprises a DLL3 antigen binding domain that specifically binds to DLL3, and polynucleotides encoding these CARs. Also provided are immune cells comprising these DLL3-specific CARs, e.g., CAR-T cells, and pharmaceutical compositions comprising these immune cells. Methods of making and using these DLL3-specific CARs and immune cells comprising these DLL3-specific CARs are also disclosed, e.g., for the treatment of cancer.

I. DLL-3 Binding Agents

The present disclosure provides DLL-3 binding agents (e.g., molecules comprising a DLL3 antigen binding domain, DLL-3 antibodies or fragments thereof), that specifically bind to DLL-3. As used herein, the term "antibody" refers to a polypeptide that includes canonical immunoglobulin sequence elements sufficient to confer specific binding to a particular target antigen (e.g., DLL-3). As is known in the art, intact antibodies as produced in nature are approximately 150 kD tetrameric agents comprised of two identical heavy chain polypeptides (about 50 kD each) and two identical light chain polypeptides (about 25 kD each) that associate with each other into what is commonly referred to as a "Y-shaped" structure. Each heavy chain is comprised of at least four domains (each about 110 amino acids long)—an amino-terminal variable (VH) domain (located at the tips of the Y structure), followed by three constant domains: CH1, CH2, and the carboxy-terminal CH3 (located at the base of the Y's stem). A short region, known as the "switch", connects the heavy chain variable and constant regions. The "hinge" connects CH2 and CH3 domains to the rest of the antibody. Two disulfide bonds in this hinge region connect the two heavy chain polypeptides to one another in an intact antibody. Each light chain is comprised of two domains—an amino-terminal variable (VL) domain, followed by a carboxy-terminal constant (CL) domain, separated from one another by another "switch". Those skilled in the art are well familiar with antibody structure and sequence elements, recognize "variable" and "constant" regions in provided sequences, and understand that there may be some flexibility in definition of a "boundary" between such domains such that different presentations of the same antibody chain sequence may, for example, indicate such a boundary at a location that is shifted one or a few residues relative to a different presentation of the same antibody chain sequence.

The assignment of amino acids to each of the framework, CDR, and variable domains is typically in accordance with numbering schemes of Kabat numbering (see, e.g., Kabat et al. in Sequences of Proteins of Immunological Interest, 5th Ed., NIH Publication 91-3242, Bethesda Md. 1991), Chothia numbering (see, e.g., Chothia & Lesk, (1987), J Mol Biol 196: 901-917; Al-Lazikani et al., (1997) J Mol Biol 273: 927-948; Chothia et al., (1992) J Mol Biol 227: 799-817; Tramontano et al., (1990) J Mol Biol 215(1): 175-82; and U.S. Pat. No. 7,709,226), contact numbering, or the AbM scheme (Antibody Modeling program, Oxford Molecular).

Accordingly, in some embodiments, the CDRs of the DLL3 binding agents presented herein are numbered according to the Kabat numbering scheme. In other embodiments, the CDRs of the DLL3 binding agents presented herein are numbered according to the Chothia numbering scheme. In other embodiments, the CDRs of the DLL3 binding agents presented herein are numbered according to the contact numbering scheme. In other embodiments, the CDRs of the DLL3 binding agents presented herein are numbered according to the AbM numbering scheme.

Intact antibody tetramers are comprised of two heavy chain-light chain dimers in which the heavy and light chains are linked to one another by a single disulfide bond; two other disulfide bonds connect the heavy chain hinge regions to one another, so that the dimers are connected to one another and the tetramer is formed. Naturally-produced antibodies are also glycosylated, typically on the CH2 domain. Each domain in a natural antibody has a structure characterized by an "immunoglobulin fold" formed from two beta sheets (e.g., 3-, 4-, or 5-stranded sheets) packed against each other in a compressed antiparallel beta barrel. Each variable domain contains three hypervariable loops known as "complement determining regions" (CDR1, CDR2, and CDR3) and four somewhat invariant "framework" regions (FR1, FR2, FR3, and FR4). When natural antibodies fold, the FR regions form the beta sheets that provide the structural framework for the domains, and the CDR loop regions from both the heavy and light chains are brought together in three-dimensional space so that they create a single hypervariable antigen binding site located at the tip of the Y structure. The Fc region of naturally-occurring antibodies binds to elements of the complement system, and also to receptors on effector cells, including for example effector cells that mediate cytotoxicity. As is known in the art, affinity and/or other binding attributes of Fc regions for Fc receptors can be modulated through glycosylation or other modification. In some embodiments, antibodies produced and/or utilized in accordance with the present invention include glycosylated Fc domains, including Fc domains with modified or engineered such glycosylation.

For purposes of the present invention, in certain embodiments, any polypeptide or complex of polypeptides that includes sufficient immunoglobulin domain sequences as found in natural antibodies can be referred to and/or used as an "antibody", whether such polypeptide is naturally produced (e.g., generated by an organism reacting to an antigen), or produced by recombinant engineering, chemical synthesis, or other artificial system or methodology. In some embodiments, an antibody is polyclonal; in some embodiments, an antibody is monoclonal. In some embodiments, an antibody has constant region sequences that are characteristic of mouse, rabbit, primate, or human antibodies. In some embodiments, antibody sequence elements are humanized, primatized, chimeric, etc, as is known in the art.

Moreover, the term "antibody" as used herein, can refer in appropriate embodiments (unless otherwise stated or clear from context) to any of the art-known or developed constructs or formats for utilizing antibody structural and functional features in alternative presentation. For example, in some embodiments, an antibody utilized in accordance with the present invention is in a format selected from, but not limited to, intact IgA, IgG, IgE or IgM antibodies; bi- or multi-specific antibodies (e.g., Zybodies®, etc); antibody fragments such as Fab fragments, Fab' fragments, F(ab')2 fragments, Fd' fragments, Fd fragments, and isolated CDRs or sets thereof; single chain Fvs; polypeptide-Fc fusions; single domain antibodies (e.g., shark single domain antibodies such as IgNAR or fragments thereof); cameloid antibodies; masked antibodies (e.g., Probodies®); Small Modular ImmunoPharmaceuticals ("SMIPs™"); single chain or Tandem diabodies (TandAb®); VHHs; Anticalins®; Nanobodies® minibodies; BiTE®s; ankyrin repeat proteins or DARPINs®; Avimers®; DARTs; TCR-like antibodies; Adnectins®; Affilins®; Trans-Bodies®; Affibodies®; TrimerX®; MicroProteins; Fynomers®, Centyrins®; and KALBITOR®s. In some embodiments, an antibody may lack a covalent modification (e.g., attachment of a glycan) that it would have if produced naturally. In some embodiments, an antibody may contain a covalent modification (e.g., attachment of a glycan, a payload (e.g., a detectable moiety, a therapeutic moiety, a catalytic moiety, etc), or other pendant group (e.g., poly-ethylene glycol, etc).

Antibodies include antibody fragments. Antibodies also include, but are not limited to, polyclonal monoclonal, chimeric dAb (domain antibody), single chain, $F_{ab}$, $F_a$, $F_{(ab)2}$ fragments, scFvs, and $F_{ab}$ expression libraries. An antibody may be a whole antibody, or immunoglobulin, or an antibody fragment.

As detailed above, whole antibodies consist of two pairs of a "light chain" (LC) and a "heavy chain" (HC) (such light chain (LC)/heavy chain pairs are abbreviated herein as LC/HC). The light chains and heavy chains of such antibodies are polypeptides consisting of several domains. In a whole antibody, each heavy chain comprises a heavy chain variable region (abbreviated herein as HCVR or VH) and a heavy chain constant region. The heavy chain constant region comprises the heavy chain constant domains CH1, CH2 and CH3 (antibody classes IgA, IgD, and IgG) and optionally the heavy chain constant domain CH4 (antibody classes IgE and IgM). Each light chain comprises a light chain variable domain VL and a light chain constant domain CL. The variable domains VH and VL can be further subdivided into regions of hypervariability, termed complementarity determining regions (CDR), interspersed with regions that are more conserved, termed framework regions (FR). Each VH and VL is composed of three CDRs and four FRs, arranged from amino-terminus to carboxy-terminus in the following order: FR1, CDR1, FR2, CDR2, FR3, CDR3, FR4 (Janeway, C. A., Jr, et al, (2001). Immunobiology, 5th ed., Garland Publishing; and Woof, J., Burton, D., Nat Rev Immunol 4 (2004) 89-99). The two pairs of heavy chain and light chain (HC/LC) are capable of specifically binding to the same antigen. Thus said whole antibody is a bivalent, monospecific antibody. Such "antibodies" include e.g., mouse antibodies, human antibodies, chimeric antibodies, humanized antibodies and genetically engineered antibodies (variant or mutant antibodies) as long as their characteristic properties are retained. In some embodiments, antibodies or binding agents are humanized antibodies, especially as recombinant human or humanized antibodies.

In some embodiments, the antibody or binding agent can be "symmetrical." By "symmetrical" is meant that the antibody or binding agent has the same kind of Fv regions (e.g., the antibody has two Fab regions). In some embodiments, the antibody or binding agent can be "asymmetrical." By "asymmetrical" is meant that the antibody or binding agent has at least two different kinds of Fv regions (e.g., the antibody has: Fab and scFv regions, Fab and scFv2 regions, or Fab-VHH regions). Various asymmetrical antibody or binding agent architectures are known in the art (Brinkman and Kontermann et al. 2017 Mabs (9)(2): 182-212).

As used herein, the term "antibody agent" refers to an agent that specifically binds to a particular antigen. In some embodiments, the term encompasses any polypeptide or polypeptide complex that includes immunoglobulin structural elements sufficient to confer specific binding. Exemplary antibody agents include, but are not limited to monoclonal antibodies or polyclonal antibodies. In some embodiments, an antibody agent may include one or more constant region sequences that are characteristic of mouse, rabbit, primate, or human antibodies. In some embodiments, an antibody agent may include one or more sequence elements are humanized, primatized, chimeric, etc, as is known in the art. In many embodiments, the term "antibody agent" is used to refer to one or more of the art-known or developed constructs or formats for utilizing antibody structural and functional features in alternative presentation. For example, an antibody agent utilized in accordance with the present invention is in a format selected from, but not limited to, intact IgA, IgG, IgE or IgM antibodies; bi- or multi-specific antibodies (e.g., Zybodies, etc); antibody fragments such as Fab fragments, Fab' fragments, F(ab')2 fragments, Fd' fragments, Fd fragments, and isolated CDRs or sets thereof; single chain Fvs; polypeptide-Fc fusions; single domain antibodies (e.g., shark single domain antibodies such as IgNAR or fragments thereof); cameloid antibodies; masked antibodies (e.g., Probodies®); Small Modular ImmunoPharmaceuticals ("SMIPs™"); single chain or Tandem diabodies (TandAb®); VHHs; Anticalins®; Nanobodies® minibodies; BiTE®s; ankyrin repeat proteins or DARPINs®; Avimers; DARTs; TCR-like antibodies; Adnectins®; Affilins®; Trans-Bodies®; Affibodies®; TrimerX®; MicroProteins; Fynomers, Centyrins; and KALBITOR®s.

In some embodiments, an antibody may lack a covalent modification (e.g., attachment of a glycan) that it would have if produced naturally. In some embodiments, an antibody may contain a covalent modification (e.g., attachment of a glycan, a payload [e.g., a detectable moiety, a therapeutic moiety, a catalytic moiety, etc], or other pendant group [e.g., poly-ethylene glycol, etc.]. In many embodiments, an antibody agent is or comprises a polypeptide whose amino acid sequence includes one or more structural elements recognized by those skilled in the art as a complementarity determining region (CDR); in some embodiments, an antibody agent is or comprises a polypeptide whose amino acid sequence includes at least one CDR (e.g., at least one heavy chain CDR and/or at least one light chain CDR) that is substantially identical to one found in a reference antibody In some embodiments, an antibody agent is or comprises a polypeptide whose amino acid sequence includes structural elements recognized by those skilled in the art as an immunoglobulin variable domain. In some embodiments, an antibody agent is a polypeptide protein having a binding domain which is homologous or largely homologous to an immunoglobulin-binding domain.

An antibody or antigen binding molecule encoded of the present invention can be single chained or double chained. In some embodiments, the antibody or antigen binding molecule is single chained. In certain embodiments, the antigen binding molecule is selected from the group consisting of an scFv, a Fab, a Fab', a Fv, a F(ab)$_2$, a dAb, and any combination thereof.

In some embodiments, an anti-DLL-3 antibody agent is isolated. In some embodiments, an antibody agent can be purified to greater than 95% or 99% purity as determined by, for example, electrophoretic (e.g., SDS-PAGE, isoelectric focusing (IEF), capillary electrophoresis) or chromatographic (e.g., ion exchange or reverse phase HPLC) (See, e.g., Flatman et al., *J. Chromatogr., B* 848:79-87 (2007)). In some aspects, the present disclosure provides a composition comprising a DLL-3 binding agent (e.g., a DLL-3 specific antibody) and a pharmaceutically acceptable carrier.

In some embodiments, an anti-DLL-3 antibody agent comprises an Fc. Fc domains can interact with cell surface receptors which can allow antibodies to activate the immune system. In IgG, IgA and IgD antibody isotypes, a Fc region is composed of two identical protein fragments, derived from the second and third constant domains of the antibody's two heavy chains; IgM and IgE Fc regions contain three heavy chain constant domains (CH domains 2-4) in each polypeptide chain. The Fc regions of IgG may bear a highly conserved N-glycosylation site (N297). Glycosylation of the Fc fragment may be essential for Fc receptor-mediated activity. The N-glycans attached to this site can predominantly be core-fucosylated diantennary structures of the complex type.

While the constant regions of the light and heavy chains may not be directly involved in binding of the antibody to an antigen, the constant regions can influence the orientation of the variable regions. The constant regions can also exhibit various effector functions, such as participation in antibody-dependent complement-mediated lysis or antibody-dependent cellular toxicity via interactions with effector molecules and cells.

The disclosed anti-DLL-3 antibody agents can be antibodies of any isotype, including isotype IgA, isotype IgD, isotype IgE, isotype IgG, or isotype IgM. In some embodiments, an anti-DLL-3 antibody contains a IgG1, IgG2, IgG3, or IgG4 constant domain.

Provided herein are DLL3 binding agents (e.g., antibodies) that can bind to various regions or domains of the DLL3 target. The epitope can be, for example, contiguous amino acids of the DLL3 target (linear or contiguous epitope) or come together from two or more non-contiguous regions of the DLL3 target (conformational, non-linear, discontinuous, or non-contiguous epitope). The epitope to which the DLL3 antigen binding domain binds can be determined by various assays, e.g., NMR spectroscopy, X-ray diffraction crystallography studies, ELISA assays, hydrogen/deuterium exchange coupled with mass spectrometry (e.g., liquid chromatography electrospray mass spectrometry), array-based oligo-peptide scanning assays, flow cytometry, and/or mutagenesis mapping (e.g., site-directed mutagenesis mapping).

Representative DLL3 regions or domains are shown in FIG. 2. Exemplary DLL3 antibodies described herein bind to DLL3 domains provided in Table 1a.

TABLE 1a

DLL3 Domains to Which Provided Clones Bind

| Clone Name | Binds to DLL3 Domain (FIG. 2A) |
|---|---|
| 2D3 | EGF3 |
| 5E12 | DSL |
| 26C8 | EGF3 |
| 2A6.C5 | EGF3 |
| 6D8 | EGF1 |
| 7F9 | N-ter |
| 8E11 | EGF3 |
| 9D3 | EGF3 |
| 11H7 | DSL |
| 16H7 | EGF2 |
| 2C3 | EGF2 |
| 4F9 | N-terminus |
| 4G9 | N-terminus |
| 2G1 | EGF5 |
| 3F2 | N-terminus |
| 17A2 | EGF1 |
| 6F8 | EGF5 |
| 9H12-K | EGF4 |
| 4H8 | EGF4 |
| 10G1-K | EGF5 |
| 11 A3 | EGF3 |
| 4E6 | EGF3 |

In some embodiments, the DLL3 binding agent comprises a variable heavy chain (VH), wherein the amino acid sequence of the VH is selected from the VH sequences presented in Table 1b. In some embodiments, an anti-DLL-3 binding agent comprises an immunoglobulin heavy chain having at least 60%, 65%, 70%, 75%, 80%, 85%, 90%, 91%, 92%, 93%, 94%, 95%, 96%, 97%, 98%, 99%, or 100%) sequence identity to an amino acid sequence presented in Table 1b.

TABLE 1b

Heavy Chain Variable Regions (VH)

| Clone | VH Sequence | SEQ ID NO: |
|---|---|---|
| 2D3 | QVQLQESGPGLVKPSETLSLTCTVSDNSISNYYWSWIRQPPGKGLEWI AYIYYSGTTNYNPSLKSRVTISLDTSKNQFSLKLSSVTAADTAVYYCA RLFNWGFAFDIWGQGTMVTVSS | SEQ ID NO: 7 |
| 5A2 | QVQLQESGPGLMKPSETLSLTCTVSGGSISSSYWSCIRQPPGKGLEWI GYIYYSGTTNYNPSLKSRVTLSLDTSKNQFSLRLTSVTAADTAVYYC ARVAPTGFWFDYWGQGTLVTVSS | SEQ ID NO: 16 |

TABLE 1b-continued

Heavy Chain Variable Regions (VH)

| Clone | VH Sequence | SEQ ID NO: |
|---|---|---|
| 7F9 | EVQLVESGGGLVQPGGSLRLSCAASGFTFSSHDMHWVRQATGKGLE<br>WVSAIGIAGDTYYSGSVKGRFTISRENAKNSLYLQMNSLRAGDTAVY<br>YCARANWGEGAFDIWGQGTMVTVSS | SEQ ID NO: 25 |
| 9D3 | QVQLQESGPGLVKPSETLSLTCTVSDDSISNYYWSWIRQPPGKLEWI<br>GYIFYSGTTNHNPSLKSRLTISLDKAKNQFSLRLSSVTAADTAVYYCA<br>RVFNWGFAFDIWGQGTMVTVSS | SEQ ID NO: 34 |
| 26C8 | QVQLQESGPGLVKPSETLSLTCTVSDNSISNYYWSWIRQPPGKLEWI<br>AYIYYSGTTNYNPSLKSRVTISLDTSKNQFSLQLSSVTAADAAVYYC<br>ARVFHWGFAFDIWGQGTMVTVSS | SEQ ID NO: 43 |
| 2A6.C5 | QVQLQESGPGLVKPSETLSLTCTVSNVSISSYYWSWIRQPPGKLEWI<br>GYIYYSGTTNYNPSLKSRVTMSVDTSKNQFSLKLSSVTAADTAVYFC<br>ARLSNWGFAFDIWGQGTMVTFSS | SEQ ID NO: 52 |
| 5E12 | EVQLVESGGGLVQPGGSLRLSCAASGFTFSSYDMHWVRQATGKGLE<br>WVSAIGPAGDTYYPGSVKGRFTISRENAKNSLYLQMNSLRAGDTAV<br>YYCARADPPYYYYGMDVWGQGTTVTVSS | SEQ ID NO: 61 |
| 6D8 | QITLKESGPTLVKPTQTLTLTCTFSGFSLSTRGVGVGWIRQPPGKALE<br>WLALIYWNDDKRYSPSLQTRLTITKDTPKNQVVLTMTNMDPVDTAT<br>YYCARSNWGNWYFALWGRGTLVTVSS | SEQ ID NO: 70 |
| 8E11 | QVQLQESGPGLVKPSETLSLTCTVSGDSISNYYWTWIRQPPGKLEWI<br>GYIYYSGTTNSNPSLKSRVTVSLDTSKQFSLNLSSVTAADTAVYYCA<br>RVFNRGFAFDIWGQGTMVTVSS | SEQ ID NO: 79 |
| 5C1.A4 | QVTLRESGPALVKPTQTLTLTCTVSGVSLSTSGMCVSWIRQPLGKAL<br>EWLGFIDWDDDKYYNTSLKTRLTISKDTSKNQVVLTMTNMDPVDTA<br>TYYCARIRGYSGSYDAFDIWGQGTVVIVSS | SEQ ID NO: 88 |
| 9F7 | QVQLQVSGPGLVKPSETLSLTCSVSGGSISSYYWSWIRQSPGKGLDWI<br>GYMYYSGTTNYNPSLKSRVTISVDTSKNQFSLKLSSVTATDTAVYYC<br>ARVGLTGFFFDYWGQGTLVTVSS | SEQ ID NO: 97 |
| 2C3 | QVQLQQWGGGLLKPSETLSLTCAVYGGSSSGNYWSWIRQPPGKRLE<br>WIGEINHSGTTSYNPSLKSRVTISVDTSKNQFSLKLSSVTAADTAVYY<br>CARGELGIADSWGQGTLVTVSS | SEQ ID NO: 106 |
| 2G1 | QLQLQESGPGLVKPSETLSLTCTVSGGSISSSSYYWGWIRQPPGKGLE<br>WIGSIYYSGNIYHNPSLKSRVSISVDTSKNQFSLRLSSVTAADTAVYY<br>CAREIIVGATHFDYWGQGTLVTVSS | SEQ ID NO: 115 |
| 3E4 | QVQLQQWGAGLLKPSETLSLTCAVYGGSFSGYYWSWIRQPPGKGLE<br>WIGEIIHSGSSNYNPSLKSRVSISVDTSKNQFSLKLSSVTAAD-<br>TAVYYC<br>SRGEYGSGSRFDYWGQGTLVTVSS | SEQ ID NO: 124 |
| 3F2 | QVQLQESGPGLVKPSGTLSLTCAVSGGSISSNNWWSWVRQPPGKGL<br>EWIGDIHHSGSTNYKPSLKSRVTISVDKSKNQFSLNLISVTAADTAVY<br>YCAREAGGYFDYWGQGILVTVSS | SEQ ID NO: 133 |
| 4F9 | QVQLQQWGAGLLKPSETLSLTCAVYGGSFSGYYWTWIRQPPGKGLE<br>WIGEITHSGSTNYNPSLKSRVSISVDTSKNQFSLKLSSVTAADTAVYY<br>CARGEYGSGSRFDYWGQGTLVTVSS | SEQ ID NO: 142 |
| 4G9 | QVQLQQWGAGLLKPSETLSLTCAVYGGSFSGYYWSWIRQPPGKGLE<br>WIGEITHSGSTNYNPSLKSRVSISVDTSKNQFSLKLSSVTAADTAVYY<br>CARGEYGSGSRFDYWGQGTLVTVSS | SEQ ID NO: 151 |
| 11H7 | QVQLQQWGAGLLKPSETLSLTCAVYGGSFSAYYWNWIRQPPGKGLE<br>WIGEINHSGSTNYNPSLKSRVTISVDTSKNQFSLNLTSLTAADTAVYY<br>CARGLDSSGWYPFDYWGQGTLVTVSS | SEQ ID NO: 160 |
| 16H7 | QVQLQQWGAGLLKPSETLSLTCAVFGGSFSGDYWSWIRQPPGKGLE<br>WIGEINHSGITSFNPSLKSRVTISVDTSKNQFSLKLSSVTAADTAV<br>YYCARGELGIPDNWGQGTLVTVSS | SEQ ID NO: 169 |
| 17A2 | QVQLQESGPGLVKPSGTLSLTCVVFGDSISSSNWWSWVRQPPGKGLE<br>WIGEVFHSGSTNYNPSLKSRVTISVDKSKNQFSLKLSSVTAADTAVY<br>YCARAAVAGALDYWGQGTLVTVSS | SEQ ID NO: 178 |

TABLE 1b-continued

Heavy Chain Variable Regions (VH)

| Clone | VH Sequence | SEQ ID NO: |
|---|---|---|
| 6H1 | QITLRESGPTLVKPTQTLTLTCTFSGFSLSTSGLGVGWIRQPPGEA LEWLALIYWNDDKRYSPSLKSRLSITKDTSKNQVVLIMTNMDPVDT ATYYCVHRRIAAPGSVYWGQGTLVTVSS | SEQ ID NO: 187 |
| 6H5 | QVQLVQSGAEVKKPGASVKVSCKVSGYTLTELSMHWVRQAPGKGP EGMGGFDpEDGKTIYAQKFQGRVTMTEDTSADTAYMELNSLRSEDT AVYYCATLLRG1DAFDVWGQGTMVTVSS | SEQ ID NO: 196 |
| 10D1 | QVQLQQWGAGLLKPSETLSLTCAVYGGSFSGYYWRWIRQPPGKGLE WIGEISHSGSTNYNPSLKSRVTISVDTSKNQFSLKLSSVTAADTAVYY CAVRGYSYGYPLFDYWGQGTLVTVSS | SEQ ID NO: 205 |
| 11F6 | QVQLQESGPGLVKPSGTLSLTCAVSGDSISSNWWTWVRQPPGKGLE WIGDIHHSGSTNYNPSLKSRVTMSVDKSENQFSLKLSSVTAADTAVF YCARDGGGTLDYWGQGTLVTVSS | SEQ ID NO: 214 |
| 6F8 | QVQLVQSGAEVKKPGSSVKVSCKASGGTFTNYCISWVRQAPGQGLE WMGGIIpIFGTTNYAQTFQGRVTITADKSTSTAYMELSSLRSEDTAVY YCARDNGDRYYYDMDVWGQGTTVTVSS | SEQ ID NO: 223 |
| 3G6-L1 | QVPLVQSGAEVKKPGSSVKVSCKASGGTFSTYSISWVRQAPGQGLE WMGGIIpIFGTTNYAQKFQGRVTITADKSTSTAYMELSSLRSEDTAVY YCARDGEGSYYYYYGMDVWGQGTTVTVSS | SEQ ID NO: 232 |
| 4C6 | QVQLQESGPGLVKPSETLSLTCTVSGDSISSYYWSWIRQPPGKGLEWI GYMYYSGITNYNPSLKSRVNISLDTSKNQFSLKLGSVTAADTAVYYC ARLSVAGFYFDYWGQGTLVTVSS | SEQ ID NO: 241 |
| 4E6 | QVQLQESGPGLVKPSETLSLTCTVSSDSISSYYWSWIRQPPGKGLEWI SYIYYSGISNYNPSLKSRVSISVDTSKNQFSLRLSSVTAADTAVYYCA RISVAGFFFDNWGQGTLVTVSS | SEQ ID NO: 250 |
| 4H8 | QVQLQQSGPGLVKPSQTLSLTCAISGDSVSSNSATWNWIRQSPSRGLE WLGRTYYRSKWYDDYAVSVKSRITINPDTSKNHLSLHLNSVTPEDTA VYYCAGGGLVGAPDGFDVWGQGTMVTVSS | SEQ ID NO: 259 |
| 9H12-K | QVQLVQSGAEVKKPGASVKVSCKASGYTFTGYSIHWVRQAPGQGLE WMGWINPNSGGTFYAQKFQGRVTMTRDTSISTVYMELSRLRSDDTA VYYCARDGWGDYYYYGLDVWGQGTTVTVSL | SEQ ID NO: 268 |
| 10G1-K | EVQLLESGGGLVQPGGSLRLSCAASGFTFSSYAMNWVRQAPGKGLE WVSTISGSGGSTYYADSVKGRFTISRDNSKNTLYLQMNSLRAEDTAV FYCAIDPEYYDILTGGDYWGQGTLVTVSS | SEQ ID NO: 277 |
| 11A3 | QVQLQESGPGLVKPSETLSLTCTVSSDSISNYYWSWIRQPPGKGLEWI SYIYYSGITNYNPSLKSRVTISVDTSKNQFSLKLSSVTAADTAVYYCA RITVTGFYFDYWGQGTLVTVSS | SEQ ID NO: 286 |
| 3B11 | QVQLQQSGPGLVKPSQTLSLTCAISGDSVSSNSVVWNWIRQSPSRGL EWLGRTYYRSKWYDDYAVSVKSRITINPDTSKNQFSLQLNSVTPEDT AVYHCARGGIVGAPDAFDIWGQGTMVTVSS | SEQ ID NO: 295 |
| 5G2 | QVQLQQSGPGLVKPSQTLSLTCAISGDSVSSNSAVWNWIRQSPSRGL EWLGWTYYRSKYYNDYAVSLKSRITINPDTSKNQFSLQLNSLTPEDT AVYYCTRGGIVGAPDGFDIWGQGTMVTVSS | SEQ ID NO: 304 |
| 11E4 | QVQLQESGPGLVKPSETLSLTCTVSGGSISSYYWSWIRQSPGKGLEWI GYVYYSDITNYNPSLKSRVTISVDTSKNQFSLNLNSVTAADTAFYFCA RIGVAGFYFDYWGQGTLVTVSS | SEQ ID NO: 313 |
| 2404.8E11 | QIQLQQSGPGLVKPSQTLSLTCAISGDSVSSNSAVWNWIRQSPSRGLE WLGRTYYRSKWYNDYAVSVKSRITIKPDTAKNQFSLQLNSVTPEDT AVYYFTRGGIVGAPDAFDIWGQGTMVTVSS | SEQ ID NO: 322 |
| 10A2 | QVQLQQSGPGLVKPSETLSLTCAISGDSVSSNSATWNWIRQSPSRGLE WLGRTYYRSEWYNDYAVSVKSRITINPDTSKNHLSLHLNSVTPEDTA VYYCAGGGIVGAPDGFDVWGQGTMVTVSS | SEQ ID NO: 331 |
| 11A8 | QVQLQQSGPGLVKPSQTLSLTCAISGDSVSSNSATWNWIRQSPSTGLE WLARTYYRSKWYNDYEVSVKSQITINPDTSKNQFSLQLNSVTPEDTA VYYCARGGIVGAPDAFDIWGQGTMVTVSS | SEQ ID NO: 340 |
| 4H5 | QVQLQESGPGLVKPSETLSLTCTVSGDSINNYFWSWIRQPPGKGLEWI GYFYHRGGNNYNPSLKSRVTISIDTSKNQFSLNLNSVTSADTAVYYC ARLALAGFFFDYWGQGTLVTVSS | SEQ ID NO: 349 |

TABLE 1b-continued

Heavy Chain Variable Regions (VH)

| Clone | VH Sequence | SEQ ID NO: |
|---|---|---|
| 3G6-L2 | QVPLVQSGAEVKKPGSSVKVSCKASGGTFSTYSISWVRQAPGQGLE WMGGIIPIFGTTNYAQKFQGRVTITADKSTSTAYMELSSLRSEDTAVY YCARDGEGSYYYYGMDVWGQGTTVTVSS | SEQ ID NO: 358 |
| 3B9 | EVQLVESGGGLVQPGGSLRLSCAASGFTFSSYSMNWVRQAPGKGLE WVSYISSSSSTIYYADSVKGRFTISRDNAKNSLYLQMNSLRDEDTAV YYCARDKERRYYYYGMDVWGQGTTVTVSS | 367 |
| 3F9-L | QVQLQQSGPGLVKPSQTLSLACAISGDSVSSNSAIWNWIRQSPSRGLE WLGGTYYRSMWYNDYAVSVKSRITINPDTSKNQLSLQLNSVTPEDT AVYYCSRGGIVGVPDAFDIWGQGTMVTVSS | SEQ ID NO: 376 |
| 3E10 | QVQLQESGPGLVKPSETLSLTCNVSDGSISSYYWTWIRQPPGKGLDW IGYIFYSGTTNYNPSLKSRVTISLDTSKNQFSLKLTSMTAADTAVYYC ARISEKSFYFDYWGQGTLVTVSS | SEQ ID NO: 385 |
| 3C3 | QVQLVQSGAEVKRPGASVKVSCKASGYTFTSYYIHWVRQAPGQGLE WMGVIVPSGGSISYAQKFQGRVTMTRDTSTNIVYMELSSLRSEDTAV YYCARDRYYGDYYYGLDVWGQGTTVTVSS | SEQ ID NO: 394 |
| 11F4 | QVHLQESGPGLVKPSETLSLTCTVSGGSISHYYWTWIRQPPGKGLEWI GYIYYSGITNFSPSLKSRVSISVDSSKNQFSLNLNSVTAADTAVYYCA GISLAGFYFDYWVQGTLVTVSS | SEQ ID NO: 403 |
| 10E12 | QVQLQESGPGLVKPSETLSLTCTVSGVSISSYYWSWIRQPPGKGLEWI AYIYYSGNTNYSPSLKSRVTISVDTSKDQLSLKLSSVTAADTAVYYCT RGGSGTIDVFDIWGQGTMVAVSS | SEQ ID NO: 412 |
| 4E1 | QVQLQQSGPGLVKPSQTLSLTCAISGDNVSTNSAAWNWIRQSPSRGL EWLGWTYYRSKWYNDYAVSLKSRININPDTSKNQFSLQLNSVTPED TAVYYCARWVNRDVFDIWGQGTMVTVSS | SEQ ID NO: 421 |
| 2404.6H1 | QVQLVESGGGVVQPGRSLRLSCAASGFTFSSYGMHWVRQTPGKGLE WVAVISYDGNSNYYADSVKGRFTISRDNSKNTLYLQMNSLRAEDTA VYYCARDGATVTSYYYYGMDVWGQGTTVTVSS | SEQ ID NO: 430 |
| 2A8-K | QVQLQQSGPGLVKPSQTLSLTCAISGDSVSSNSAVWNWIRQSPSRGL EWLGRTYYRSKWYNDYAVSVKSRITINPDTSRNQFSLQLNSVTPEDT AVYYCARGGIVGAPDGFDIWGQGTMVTVSS | SEQ ID NO: 439 |
| 3B1 | QVQLQQSGPGLVKPSQTLSLTCAISGDSVSSNTTAWKWSRQSPSKGL EWLGWTYYRSKWYYDYTVSVKSRITINPDTSKNQFSLQLNSVTPEDT AVYYCARWIFHDAFDIWGQGTMVTVSS | SEQ ID NO: 448 |
| 9B5 | QVQLQESGPGLVKPSETLSLTCTVSGDSISSLSWSWIRQTPGEGLEWI GYLYYSGSTDYNPSLKSRVTISVDTSKNQFSLKLRSVAAADTALYYC ARGRRAFDIWGQGTMVTVSS | SEQ ID NO: 457 |
| 11A5 | QVQLVQSGAEVKKPGASVKVSCKASGYTFTGYYMHWVRQAPGQGL EWMGWINPNSGGTNYAQKFQGRVTMTRDTSVSTAYMELSRLTSDD TAIYYCAKDGGGDFYFGMDVWGQGTTVTVSS | SEQ ID NO: 466 |

In some embodiments, the DLL3 binding agent comprises a variable light chain (VL), wherein the amino acid sequence of the VL is selected from the VL sequences presented in Table 1c. In some embodiments, an anti-DLL-3 binding agent comprises an immunoglobulin light chain having at least 60%, 65%, 70%, 75%, 80%, 85%, 90%, 91%, 92%, 93%, 94%, 95%, 96%, 97%, 98%, 99%, or 100%) sequence identity to an amino acid sequence presented in Table 1c.

TABLE 1c

Light Chain Variable Regions

| Clone | VL Sequence | SEQ ID NO: |
|---|---|---|
| 2D3 | EIVMTQSPATLSVSPGERATLSCRASQSVSSNLAWYQQKPGQAPR LLIYGASTRATGIPARFSGSGSGTEFTLTISSLQSEDFAVYYCQQY NNWPLTFGGGTKVEIK | SEQ ID NO: 8 |
| 5A2 | EIVLTQSPGTLSLSPGERATLSCRASQRVSSRYLAWYQQKPGQAP RLLIYGASSRATGIPDRFSGSGSGTDFTLTISRLEPEEFAVYYCQQ YGTSPLTFGGGTKVEIK | SEQ ID NO: 17 |

TABLE 1c-continued

Light Chain Variable Regions

| Clone | VL Sequence | SEQ ID NO: |
|---|---|---|
| 7F9 | DIQMTQSPSSLSASVGDRVTITCRASQGISDYLAWYQQKPGKIPK LLIYAASTLQSGVPSRFSGSGSGTDFTLTISSLQPEDVATYYCQKY NSVPLTFGGGTKVEIK | SEQ ID NO: 26 |
| 9D3 | EIVLTQSPGTLSLSPGERATLSCRASQRISRTYLAWYQQKPGQAP RLLIYGASSRATGIPDRFTGSGSGTDFTLTISRLEPEDFAVYYCQQ YGTSPLTFGGGTKVEIN | SEQ ID NO: 35 |
| 26C8 | EIVLTQSPGTLSLSPGERATLSCRASQRVSNTYLAWYQQNPGQAP RLLIYGASSRATGIPDRFSGSGSGTDFTLTISRLEPEDFAVYYCQQ YGTSPLTFGGGTKVEIK | SEQ ID NO: 44 |
| 2A6.C5 | EIVLTQSPGTLSLSPGERATLSCRASQTISSSYLAWYQQKPGQAPR LLIYGASSRATGIPDRFSGSGSGTEFTLTISRLEPEDFAVYYCQQY GWSPITFGQGTRLEIK | SEQ ID NO: 53 |
| 5E12 | DIVMTQSPLSLPVTPGEPASISCRSSQSLLHSNEYNYLDWYLQKP GQSPQLLIYLGSNRASGVPDRFSGSGSGTDFILKISRVEAEDVGVY YCMQALEIPLTFGGGTKVEIK | SEQ ID NO: 62 |
| 6D8 | EIVLTQSPATLSLSPGERATLSCRASQSVSSYLAWYQQKPGQAPR LLIYDAFYRATGIPARFSGSGSGTDFTLTISSLEPEDFAVYYCQHR SNWPITFGQGTRLEIK | SEQ ID NO: 71 |
| 8E11 | EIVLTQSPGTLSLSPGERATLSCRASQRISNTYLAWYQQKPGQAP RLLIYGASSRATGIPDRFSGSGSGTDFTLTISRLEPEDFAAYYCQQ YDTSPLTFGGGTKVEIK | SEQ ID NO: 80 |
| 5C1.A4 | DIVMTQSPLSLPVTPGEPASISCRSSQSLLHSNGYNHLDWYLQKP GQSPQVLIYLGSNRASGVPDRFSGSGSGTDFTLKISRVEAEDVGV YFCMQALQTPLTFGGGTKVEIK | SEQ ID NO: 89 |
| 9F7 | AIQMTQSPSSLSASVGDRVTITCRASQGIRNDLGWYQQKPGKAP KLLIYAASSLQSGVPSRFSGSGSGTDFTLTVSSLQPEDFATYYCLQ DYNYPYTFGQGTKLEIK | SEQ ID NO: 98 |
| 2C3 | DIQMTQSPSTLSASVGDRVTITCRASQSISRWLAWYQQKPGKAPK LLIYKASSLESGVPSRFSGSGSGTEFTLTISSLQPDDFATYYCQQY NSYSTFGQGTKVEIK | SEQ ID NO: 107 |
| 2G1 | AIQMTQSPSSLSASVGDRVTITCRASQGIRNDLGWYQQKPGKAPE LLIYAASSLQSGVPSRFSGSGSGTDFTLTISSLQPEDFATYYCLQD YNYPLTFGPGTKVDIK | SEQ ID NO: 116 |
| 3E4 | AIQMTQSPSSLSASVGDRVAITCRASQGIRDDLGWYQQKPGKAP KLLIYAASSLQSGVPSRFSGSRSDTDFTLTISSLQPEDFATYYCLQ DYDYPLTFGGGTKVEIK | SEQ ID NO: 125 |
| 3F2 | DIQMTQSPSTLSASVGDRVTITCRASQSISSWLAWYQQKPGKAPK LLISKASSLESGVPSRFSGSGSGPEFTLTISSLQPADFA-TYYCQQYN SYSTFGQGTKLEIK | SEQ ID NO: 134 |
| 4F9 | AIQMTQSPSSLSASVGDRVAITCRASQGIRDDLGWYQQKPGKAP KLLIYAASSLQSGVPSRFSGSGSDTDFTLTISSLQPEDFATYYCLQ DYDYPLTFGGGTKVEIK | SEQ ID NO: 143 |
| 4G9 | AIQMTQSPSSLSASVGDRVALTCRASQGIRDDLGWYQQKPGKAP KLLIYAASSLQSGVPSRFSGSGSDTDFTLTISSLQPEDFATYYCLQ DYDYPLTFGGGTKVEIK | SEQ ID NO: 152 |
| 11H7 | DIQMTQSPSSVSASVGDRVTITCRASQGISSWLAWYQQKPGKAP KLLIYAASSLQSGVPSRFSGSGSGTDFTLTISSLQPEDFATYYCQQ ADSFPFTFGPGTKVDIK | SEQ ID NO: 161 |
| 16H7 | DIQMTQSPSTLSASVGDRVTITCRASQSISRWLAWYQQKPGKAPK LLIYKASSLESGVPSRFSGSGSGTEFTLTISSLQPDDFATYYCQQY NSYSTFGQGTKVEIK | SEQ ID NO: 170 |
| 17A2 | DIVMTQSPDSLAVSLGERATINCKSSQSVLYSSNNKnYLAWYQQ KPGQPPNLLVYWASTRESGVPDRFSGAGSGTDFTLTISSLQAEDV AVYYCQQYYGTSWTFGQGTKVEIK | SEQ ID NO: 179 |
| 6H1 | DIQMTQSPSSVSASVGDRVTITCRASQGISSWLAWYQQKPGKAP KLLISAASSLQSGVPSRFSGSGSGTDFTLTISSLQPEDFATYYCHQ ANSFPFTFGQGTKLEIK | SEQ ID NO: 188 |

TABLE 1c-continued

Light Chain Variable Regions

| Clone | VL Sequence | SEQ ID NO: |
|---|---|---|
| 6H5 | DIQMTQSPSSLSASVGDRVTITCRASQGIRNDLGWYQQKPGKAP KRLIYAASSLQSGVPSRFSGSGSGTEFTLTISTLQPEDFATYYCLQ HNSYPRTFGQGTKVEIK | SEQ ID NO: 197 |
| 10D1 | DIQMTQSPSSLSASVGDRVTITCRASQGIRNDLGWYQQKLGKAP KRLIYAASSLQSGVPSRFSGSGSGTEFTLTISSLQPEDFATYYCLQ YNSYPRTFGQGTKVEIK | SEQ ID NO: 206 |
| 11F6 | DIQMTQSPSTLSASVGDRVTITCRASQSISSWLAWYQQKPGKAPK LLIYKASTLESGVPSRFSGSGSGTEFTLTISSLQPDDFATYYCQQY NGYSTFGQGTKVEIK | SEQ ID NO: 215 |
| 6F8 | QSVLTQPPSVSAAPGQKVTISCSGSSSNIGNNYVSWYQQLPGTAP KLLIYDNNKRPSGIPDRFSGSKSGTSATLGITGLQTGDEADYYCG TWDSSLSAVVFGGGTKLTVL | SEQ ID NO: 224 |
| 3G6-L1 | QSVLTQPPSVSAAPGQKVTISCSGSSSNIGNNYVSWYQQLPGTAP KLLIYDNNKRPSGIPDRFFGSKFGTSATLGITGLQTGDEADYYCG TWDSSLSAVVFGGGTKLTVL | SEQ ID NO: 233 |
| 4C6 | EIVLTQSPGTLSLSPGERATLSCRASQSVTRSYLAWYQQKPGQAP RLLIYGASSRATDIPDRFSGSGSGTDFTLTINRLEPEDFAVYYCQQ YGTSPLTFGGGTKVEIK | SEQ ID NO: 242 |
| 4E6 | EIMLTQSPDTLSLSPGERATLSCRASQSVSSSYLAWYQQKPGQAP RLLIYGASSRAAGVPDRFSGSGSGTDFTLTISRLAPEDFVVYYCQ QYGISPLTFGGGTKVEIK | SEQ ID NO: 251 |
| 4H8 | QSVLTQPPSASGTPGQRVTISCSGSSSNIGSDPVNWYQQLPGTAPK LLIYSNNQRPSGVPDRFSGSKSGTSASLAISGLQSEDEADYYCSA WDDSLNGYVFGTGTKVTVL | SEQ ID NO: 260 |
| 9H12-K | DIQMTQSPSSVSASVGDRVTITCRASQDISSWLAWYQQKPGKAP KLLIYTASSLQGGVPSRFSGSGSGTDFTLTISSLQPEDLATYSCQQ ANVFPYTFGQGTKLEIK | SEQ ID NO: 269 |
| 10G1-K | DIQMTQSPSAMSASVGDRVTITCRASQGISNYLAWFQQKPGKVP KRLIYAASSLQSGVPSRFSGSGSGTEFTLTISSLQPEDFA- TYFCLQH DSFPLTFGGGTKVEIK | SEQ ID NO: 278 |
| 11A3 | EIVLTQSPGTLSLSPGERATLSCRASQSISRSYLAWYQQKPGQAPR HLIYGASSRATGIPDRFSGSGSGTDFILTISRLEPEDFAVYYCQQY DTSPLTFGGGTKVEIK | SEQ ID NO: 287 |
| 3B11 | QSVLTQPPSASGTPGQRVTISCSGSSSNIGSDPVSWYQQFPGTAPK LLIYTNNQRPSGVPDRFSGSKSGTSASLAISGLQSEDEADYYCAA WDDSLNGHVFGTGTKVTVL | SEQ ID NO: 296 |
| 5G2 | QSALTQPPSASGTPGQRVTISCSGSNSNIGSNPINWYQQLPGTAPK LLIYSNNQRPSGVPDRFSGSKSGTSASLAISGLQSEDEADYYCAA WDDSLNGHVFGTGTKVTVL | SEQ ID NO: 305 |
| 11E4 | EIVLTQSPDTLSLSPGERATLSCRASQSVSRRYLAWYQQKPGQAP RLLIYGASSRATGIPDRFSGSGSGTDFTLTISRLEPEDFEVYYCQQ YGTSPITFGQGTRLEIK | SEQ ID NO: 314 |
| 2404.8E11 | QSVLTQPPSASGTPGQRVTISCSGSSSNIGSDPINWYQQVPGTAPK LLIYSNNQRPSGVPDRFSGSKSGTSASLAISGLQSEDEADYYCAA WDDSLNGYVFGTGTKVTVL | SEQ ID NO: 323 |
| 10A2 | QSVLTQPPSASGTPGQRVTISCSGSSSNIGSDPVIWYQQLPRTAPK LLIYSNNQRPSGVPDRFSGSKSGTSASLAISGLQSEDEADYYCAA WDDSLNGYVFGTGTKVTVL | SEQ ID NO: 332 |
| 11A8 | QSVLTQPPSASGTPGQGVTISCSGSSSNIGSNPVNWYQQLPGTAP KLLIYSNNQRPSGVPDRFSDSKSGTSASLAISGLQSEDEADYYCSA WDDWLNGYVFGTGTKVTVL | SEQ ID NO: 341 |
| 4H5 | DIQMTQSPSTLSASVGDRVTITCRASQSISSWLAWYQQKPGKAPK LLIYKASSLESGVPSRFSGSGSGTEFTLTISSLQPDDFATYYCQQY NSYSRTFGQGTKVEIK | SEQ ID NO: 350 |

TABLE 1c-continued

Light Chain Variable Regions

| Clone | VL Sequence | SEQ ID NO: |
|---|---|---|
| 3G6-L2 | QSVLTQPPSASGTPGQRVTISCSGSSSNIGSNYVYWYQQLPGTAP KLLIYSNNQRPSGVPDRFSGSKSGTSASLAISGLRSEDEADYYCA AWDDSLSGWVFGGGTKLTVL | SEQ ID NO: 359 |
| 3B9 | EIVLTQSPDTLSLSPGERATLSCRASQSVSRRYLAWYQQKPGQAP RLLIYGASSRATGIPDRFSGSGSGTDFTLTISRLEPED-FAVYYCQQF GTSPITFGQGTRLEIK | SEQ ID NO: 368 |
| 3F9-L | QSVLTQPPSASGTPGQRVTISCSGSSSNIGSNTANWYQQLPGTAPR LLIYRNNQRPSGVPDRFSGSKSGTSASLAISGLQSEDEADYYCAA WDDSLNGYVFGTGTKVTVL | SEQ ID NO: 377 |
| 3E10 | QSVLTQPPSASGTPGQRVTISCSGSSSNIGSNYVYWYQQLPGTAP KLLIYSNNQRPSGVPDRFSGSKSGTSASLAISGLRSEDEADYYCAP WDDSLSGRVFGGGTKLTVL | SEQ ID NO: 386 |
| 3C3 | DIQMTQSPSSLSASVGDRVTITCRASQGINNFLAWFQQKPGKAPK SLIYAASSLQSGVPSKFSGSGSGTDFTLTIRSLQPEDFATYYCQHY NSYPITFGQGTRLEIK | SEQ ID NO: 395 |
| 11F4 | EIVLTQSPGTLSLSPGERATLSCRASQSVSRSYLAWYQQKPGQAP RLLIYGASSRATGVPDRFSGSGSGTDFTLTISRLEPEDFAVFYCQQ YSISPLTFGGGTKVEIK | SEQ ID NO: 404 |
| 10E12 | QSVLTQPPSVSAAPGQKVTISCSGSSSNIGNNYVSWYQQLPGTAP KLLIYDNNKRPSGIPDRFSGSKSGTSATLGITGLQTGDEADYYCET WDSSLSAVVFGGGTKLTVL | SEQ ID NO: 413 |
| 4E1 | QSALTQPASVSGSPGQSITISCTGTSSDVGSYNLVSWYQQHPGKA PKLMIYEGSKRPSGVSNRFSGSKSGNTASLTISGLQAEDEADYYC CSYAGSSTWVFGGGTKLTVL | SEQ ID NO: 422 |
| 2404.6H1 | EIVLTQSPGTLSLSPGERATLSCRASQSVSRTYLAWYHQKPGQAP RLLIYGASSRATGISDRFSGSGSGTDFTLTISRLEPEDFAVYYCQQ YGTSPITFGQGTRLEIK | SEQ ID NO: 431 |
| 2A8-K | DIVMTQSPDSLAVSLGERATINCKSSQSVLDSSNNNnYFAWYQQR PGQPPHLLIYWASSRESGVPDRFSGSGSGTDFTLTISSLQAEDVAV YYCQQYYSTPYTFGQGTKLEIK | SEQ ID NO: 440 |
| 3B1 | QSALTQPPSASGTPGQRVTISCSGSSSNIGSNTVNWYQQLPGTAP KLLIYTNNQRPSGVPDRFSGSKSGTSASLAISGLQSEDEADYFCST WDDSLNGPVFGGGTKLTVL | SEQ ID NO: 449 |
| 9B5 | DIQMTQSPSSLSASVGDRVTITCRGSQGISNYLAWFQQRPGKAPK SLIYAASSLESGVPSKFSGSGSGTDFTLTIISLQPEDFA-TYYCQQYY NYPITFGQGTRLEIK | SEQ ID NO: 458 |
| 11A5 | QTVVTQEPSFSVSPGGTVTLTCGLSSGSVSTSYYPSCFQQTPGQAP RTLIYSTDTRSSGVPDRFSGSILGNKAALTITGAQADDESDYYCVL YMGSGISVFGGGTKLTVL | SEQ ID NO: 467 |

Provided herein are DLL3 binding agents (e.g., antibodies), wherein the DLL3 antigen binding domain comprises a variable heavy chain (VH) and a variable light chain, wherein the amino acid sequence of the VH is selected from the VH sequences presented in Table 1b; and the amino acid sequence of the VL is selected from the VL sequences presented in Table 1c.

In some embodiments, the DLL-3 binding agent comprises a heavy chain CDR1, CDR2, and CDR3. In some embodiments, the heavy chain CDR1, CDR2, and CDR3 sequences are selected from the heavy chain CDRs presented in Table 1e.

TABLE 1e

Heavy Chain CDRs

| Clone | CDR1 VH Sequence | SEQ ID NO: |
|---|---|---|
| 2D3 | NSISNYYWS | SEQ ID NO: 1 |
| 5A2 | GSISSSYWS | SEQ ID NO: 10 |
| 7F9 | FTFSSHDMH | SEQ ID NO: 19 |
| 9D3 | DSISNYYWS | SEQ ID NO: 28 |

TABLE 1e-continued

Heavy Chain CDRs

| Clone | CDR1 VH Sequence | SEQ ID NO: |
|---|---|---|
| 26C8 | NSISNYYWS | SEQ ID NO: 37 |
| 2A6.C5 | VSISSYYWS | SEQ ID NO: 46 |
| 5E12 | FTFSSYDMH | SEQ ID NO: 55 |
| 6D8 | FSLSTRGVGVG | SEQ ID NO: 64 |
| 8E11 | DSISNYYWT | SEQ ID NO: 73 |
| 5C1.A4 | VSLSTSGMCVS | SEQ ID NO: 82 |
| 9F7 | GSISSYYWS | SEQ ID NO: 91 |
| 2C3 | GSSSGNYWS | SEQ ID NO: 100 |
| 2G1 | GSISSSSYYWG | SEQ ID NO: 109 |
| 3E4 | GSFSGYYWS | SEQ ID NO: 118 |
| 3F2 | GSISSNWWS | SEQ ID NO: 127 |
| 4F9 | GSFSGYYWT | SEQ ID NO: 136 |
| 4G9 | GSFSGYYWS | SEQ ID NO: 145 |
| 11H7 | GSFSAYYWN | SEQ ID NO: 154 |
| 16H7 | GSFSGDYWS | SEQ ID NO: 163 |
| 17A2 | DSISSSNWWS | SEQ ID NO: 172 |
| 6H1 | FSLSTSGLGVG | SEQ ID NO: 181 |
| 6H5 | YTLTELSMH | SEQ ID NO: 190 |
| 10D1 | GSFSGYYWR | SEQ ID NO: 199 |
| 11F6 | DSISSNWWT | SEQ ID NO: 208 |
| 6F8 | GTFTNYCIS | SEQ ID NO: 217 |
| 3G6-L1 | GTFSTYSIS | SEQ ID NO: 226 |
| 4C6 | DSISSYYWS | SEQ ID NO: 235 |
| 4E6 | DSISSYYWS | SEQ ID NO: 244 |
| 4H8 | DSVSSNSATWN | SEQ ID NO: 253 |
| 9H12-K | YTFTGYSIH | SEQ ID NO: 262 |
| 10G1-K | FTFSSYAMN | SEQ ID NO: 271 |
| 11A3 | DSISNYYWS | SEQ ID NO: 280 |
| 3B11 | DSVSSNSVVWN | SEQ ID NO: 289 |
| 5G2 | DSVSSNSAVWN | SEQ ID NO: 298 |
| 11E4 | GSISSYYWS | SEQ ID NO: 307 |
| 2404.8E11 | DSVSSNSAVWN | SEQ ID NO: 316 |
| 10A2 | DSVSSNSATWN | SEQ ID NO: 325 |
| 11A8 | DSVSSNSATWN | SEQ ID NO: 334 |
| 4H5 | DSINNYFWS | SEQ ID NO: 343 |
| 3G6-L2 | GTFSTYSIS | SEQ ID NO: 352 |
| 3B9 | FTFSSYSMN | SEQ ID NO: 361 |
| 3F9-L | DSVSSNSAIWN | SEQ ID NO: 370 |
| 3E10 | GSISSYYWT | SEQ ID NO: 379 |
| 3C3 | YTFTSYYIH | SEQ ID NO: 388 |
| 11F4 | GSISHYYWT | SEQ ID NO: 397 |
| 10E12 | VSISSYYWS | SEQ ID NO: 406 |
| 4E1 | DNVSTNSAAWN | SEQ ID NO: 415 |
| 2404.6H1 | FTFSSYGMH | SEQ ID NO: 424 |
| 2A8-K | DSVSSNSAVWN | SEQ ID NO: 433 |
| 3B1 | DSVSSNTTAWK | SEQ ID NO: 442 |
| 9B5 | DSISSLSWS | SEQ ID NO: 451 |
| 11A5 | YTFTGYYMH | SEQ ID NO: 460 |
| 2D3 | AYIYYSGTTNYN | SEQ ID NO: 2 |
| 5A2 | GYIYYSGTTNYN | SEQ ID NO: 11 |
| 7F9 | SAIGIAGDTYYS | SEQ ID NO: 20 |
| 9D3 | DSISNYYWS<br>GYIFYSGTTNHN | SEQ ID NO: 29<br>SEQ ID NO: 695 |
| 26C8 | AYIYYSGTTNYN | SEQ ID NO: 38 |
| 2A6.C5 | GYIYYSGTTNYN | SEQ ID NO: 47 |
| 5E12 | SAIGPAGDTYYP | SEQ ID NO: 56 |
| 6D8 | ALIYWNDDKRYS | SEQ ID NO: 65 |
| 8E11 | GYIYYSGTTNSN | SEQ ID NO: 74 |
| 5C1.A4 | GFIDWDDDKYYN | SEQ ID NO: 83 |
| 9F7 | GYMYYSGTTNYN | SEQ ID NO: 92 |
| 2C3 | GEINHSGTTSYN | SEQ ID NO: 101 |
| 2G1 | GSIYYSGNIYHN | SEQ ID NO: 110 |
| 3E4 | GEIIHSGSSNYN | SEQ ID NO: 119 |
| 3F2 | GDIHHSGSTNYK | SEQ ID NO: 128 |
| 4F9 | GEITHSGSTNYN | SEQ ID NO: 137 |
| 4G9 | GEITHSGSTNYN | SEQ ID NO: 146 |
| 11H7 | GEINHSGSTNYN | SEQ ID NO: 155 |
| 16H7 | GEINHSGITSFN | SEQ ID NO: 164 |
| 17A2 | GEVFHSGSTNYN | SEQ ID NO: 173 |
| 6H1 | ALIYWNDDKRYS | SEQ ID NO: 182 |
| 6H5 | GGFDPEDGKTIYA | SEQ ID NO: 191 |
| 10D1 | GEISHSGSTNYN | SEQ ID NO: 200 |
| 11F6 | GDIHHSGSTNYN | SEQ ID NO: 209 |
| 6F8 | GGIIPIFGTTNYA | SEQ ID NO: 218 |
| 3G6-L1 | GGIIPIFGTTNYA | SEQ ID NO: 227 |
| 4C6 | GYMYYSGITNYN | SEQ ID NO: 236 |
| 4E6 | SYIYYSGISNYN | SEQ ID NO: 245 |

TABLE 1e-continued

Heavy Chain CDRs

| Clone | CDR1 VH Sequence | SEQ ID NO: |
|---|---|---|
| 4H8 | GRTYYRSKWYDDYA | SEQ ID NO: 254 |
| 9H12-K | GWINPNSGGTFYA | SEQ ID NO: 263 |
| 10G1-K | STISGSGGSTYYA | SEQ ID NO: 272 |
| 11A3 | SYIYYSGITNYN | SEQ ID NO: 281 |
| 3B11 | GRTYYRSKWYDDYA | SEQ ID NO: 290 |
| 5G2 | GWTYYRSKYYNDYA | SEQ ID NO: 299 |
| 11E4 | GYVYYSDITNYN | SEQ ID NO: 308 |
| 2404.8E11 | GRTYYRSKWYNDYA | SEQ ID NO: 317 |
| 10A2 | GRTYYRSEWYNDYA | SEQ ID NO: 326 |
| 11A8 | ARTYYRSKWYNDYE | SEQ ID NO: 335 |
| 4H5 | GYFYHRGGNNYN | SEQ ID NO: 344 |
| 3G6-L2 | GGIIPIFGTTNYA | SEQ ID NO: 353 |
| 3B9 | SYISSSSSTIYYA | SEQ ID NO: 362 |
| 3F9-L | GGTYYRSMWYNDYA | SEQ ID NO: 371 |
| 3E10 | GYIFYSGTTNYN | SEQ ID NO: 380 |
| 3C3 | GVIVPSGGSISYA | SEQ ID NO: 389 |
| 11F4 | GYIYYSGITNFS | SEQ ID NO: 398 |
| 10E12 | AYIYYSGNTNYS | SEQ ID NO: 407 |
| 4E1 | GWTYYRSKWYNDYA | SEQ ID NO: 416 |
| 2404.6H1 | AVISYDGNSNYYA | SEQ ID NO: 425 |
| 2A8-K | GRTYYRSKWYNDYA | SEQ ID NO: 434 |
| 3B1 | GWTYYRSKWYYDYT | SEQ ID NO: 443 |
| 9B5 | GYLYYSGSTDYN | SEQ ID NO: 452 |
| 11A5 | GWINPNSGGTNYA | SEQ ID NO: 461 |
| 2D3 | CARLFNWGFAFDIW | SEQ ID NO: 3 |
| 5A2 | CARVAPTGFWFDYW | SEQ ID NO: 12 |
| 7F9 | CARANWGEGAFDIW | SEQ ID NO: 21 |
| 9D3 | CARVFNWGFAFDIW | SEQ ID NO: 30 |
| 26C8 | CARVFHWGFAFDIW | SEQ ID NO: 39 |
| 2A6.C5 | CARLSNWGFAFDIW | SEQ ID NO: 48 |
| 5E12 | CARADPPYYYYGMDVW | SEQ ID NO: 57 |
| 6D8 | CARSNWGNWYFALW | SEQ ID NO: 66 |
| 8E11 | CARVFNRGFAFDIW | SEQ ID NO: 75 |
| 5C1.A4 | CARIRGYSGSYDAFDIW | SEQ ID NO: 84 |
| 9F7 | CARVGLTGFFFDYW | SEQ ID NO: 93 |
| 2C3 | CARGELGIADSW | SEQ ID NO: 102 |
| 2G1 | CAREIIVGATHFDYW | SEQ ID NO: 111 |
| 3E4 | CSRGEYGSGSRFDYW | SEQ ID NO: 120 |
| 3F2 | CAREAGGYFDYW | SEQ ID NO: 129 |
| 4F9 | CARGEYGSGSRFDYW | SEQ ID NO: 138 |
| 4G9 | CARGEYGSGSRFDYW | SEQ ID NO: 147 |
| 11H7 | CARGLDSSGWYPFDYW | SEQ ID NO: 156 |
| 16H7 | CARGELGIPDNW | SEQ ID NO: 165 |
| 17A2 | CARAAVAGALDYW | SEQ ID NO: 174 |
| 6H1 | CVHRRIAAPGSVYW | SEQ ID NO: 183 |
| 6H5 | CATLLRGLDAFDVW | SEQ ID NO: 192 |
| 10D1 | CAVRGYSYGYPLFDYW | SEQ ID NO: 201 |
| 11F6 | CARDGGGTLDYW | SEQ ID NO: 210 |
| 6F8 | CARDNGDRYYYDMDVW | SEQ ID NO: 219 |
| 3G6-L1 | CARDGEGSYYYYGMDVW | SEQ ID NO: 228 |
| 4C6 | CARLSVAGFYFDYW | SEQ ID NO: 237 |
| 4E6 | CARISVAGFFFDNW | SEQ ID NO: 246 |
| 4H8 | CAGGGLVGAPDGFDVW | SEQ ID NO: 255 |
| 9H12-K | CARDGWGDYYYYGLDVW | SEQ ID NO: 264 |
| 10G1-K | CAIDPEYYDILTGGDYW | SEQ ID NO: 273 |
| 11A3 | CARITVTGFYFDYW | SEQ ID NO: 282 |
| 3B11 | CARGGIVGAPDAFDIW | SEQ ID NO: 291 |
| 5G2 | CTRGGIVGAPDGFDIW | SEQ ID NO: 300 |
| 11E4 | CARIGVAGFYFDYW | SEQ ID NO: 309 |
| 2404.8E11 | FTRGGIVGAPDAFDIW | SEQ ID NO: 318 |
| 10A2 | CAGGGIVGAPDGFDVW | SEQ ID NO: 327 |
| 11A8 | CARGGIVGAPDAFDIW | SEQ ID NO: 336 |
| 4H5 | CARLALAGFFFDYW | SEQ ID NO: 345 |
| 3G6-L2 | CARDGEGSYYYYGMDVW | SEQ ID NO: 354 |
| 3B9 | CARDKERRYYYYGMDVW | SEQ ID NO: 363 |
| 3F9-L | CSRGGIVGVPDAFDIW | SEQ ID NO: 372 |
| 3E10 | CARISEKSFYFDYW | SEQ ID NO: 381 |
| 3C3 | CARDRYYGDYYYGLDVW | SEQ ID NO: 390 |
| 11F4 | CAGISLAGFYFDYW | SEQ ID NO: 399 |
| 10E12 | CTRGGSGTIDVFDIW | SEQ ID NO: 408 |
| 4E1 | CARWVNRDVFDIW | SEQ ID NO: 417 |
| 2404.6H1 | CARDGATVTSYYYYGMDVW | SEQ ID NO: 426 |
| 2A8-K | CARGGIVGAPDGFDIW | SEQ ID NO: 435 |
| 3B1 | CARWIFHDAFDIW | SEQ ID NO: 444 |

TABLE 1e-continued

Heavy Chain CDRs

| Clone | CDR1 VH Sequence | SEQ ID NO: |
|---|---|---|
| 9B5 | CARGRRAFDIW | SEQ ID NO: 453 |
| 11A5 | CAKDGGGDFYFYGMDVW | SEQ ID NO: 462 |

In some embodiments, the DLL-3 binding agent comprises a light chain CDR1, CDR2, and CDR3. In some embodiments, the light chain CDR1, CDR2, and CDR3 sequences are selected from the light chain CDRs presented in Table 1f.

TABLE 1f

Light Chain CDRs

| Clone | CDR1 VL Sequence | SEQ ID NO: |
|---|---|---|
| 2D3 | RASQSVSSNLA | SEQ ID NO: 4 |
| 5A2 | RASQRVSSRYLA | SEQ ID NO: 13 |
| 7F9 | RASQGISDYLA | SEQ ID NO: 22 |
| 9D3 | RASQRISRTYLA | SEQ ID NO: 31 |
| 26C8 | RASQRVSNTYLA | SEQ ID NO: 40 |
| 2A6.C5 | RASQTISSSYLA | SEQ ID NO: 49 |
| 5E12 | RSSQSLLHSNEYNYLD | SEQ ID NO: 58 |
| 6D8 | RASQSVSSYLA | SEQ ID NO: 67 |
| 8E11 | CARVFNRGFAFDIW | SEQ ID NO: 76 |
|  | RASQRISNTYLA | SEQ ID NO: 696 |
| 5C1.A4 | RSSQSLLHSNGYNHLD | SEQ ID NO: 85 |
| 9F7 | RASQGIRNDLG | SEQ ID NO: 94 |
| 2C3 | RASQSISRWLA | SEQ ID NO: 103 |
| 2G1 | RASQGIRNDLG | SEQ ID NO: 112 |
| 3E4 | RASQGIRDDLG | SEQ ID NO: 121 |
| 3F2 | RASQSISSWLA | SEQ ID NO: 130 |
| 4F9 | RASQGIRDDLG | SEQ ID NO: 139 |
| 4G9 | RASQGIRDDLG | SEQ ID NO: 148 |
| 11H7 | RASQGISSWLA | SEQ ID NO: 157 |
| 16H7 | RASQSISRWLA | SEQ ID NO: 166 |
| 17A2 | KSSQSVLYSSNNKNYLA | SEQ ID NO: 175 |
| 6H1 | RASQGISSWLA | SEQ ID NO: 184 |
| 6H5 | RASQGIRNDLG | SEQ ID NO: 193 |
| 10D1 | RASQGIRNDLG | SEQ ID NO: 202 |
| 11F6 | RASQSISSWLA | SEQ ID NO: 211 |
| 6F8 | SGSSSNIGNNYVS | SEQ ID NO: 220 |
| 3G6-L1 | SGSSSNIGNNYVS | SEQ ID NO: 229 |
| 4C6 | RASQSVTRSYLA | SEQ ID NO: 238 |

TABLE 1f-continued

Light Chain CDRs

| Clone | CDR1 VL Sequence | SEQ ID NO: |
|---|---|---|
| 4E6 | RASQSVSSSYLA | SEQ ID NO: 247 |
| 4H8 | SGSSSNIGSDPVN | SEQ ID NO: 256 |
| 9H12-K | RASQDISSWLA | SEQ ID NO: 265 |
| 10G1-K | RASQGISNYLA | SEQ ID NO: 274 |
| 11A3 | RASQSISRSYLA | SEQ ID NO: 283 |
| 3B11 | SGSSSNIGSDPVS | SEQ ID NO: 292 |
| 5G2 | SGSNSNIGSNPIN | SEQ ID NO: 301 |
| 11E4 | RASQSVSRRYLA | SEQ ID NO: 310 |
| 2404.8E11 | SGSSSNIGSDPIN | SEQ ID NO: 319 |
| 10A2 | SGSSSNIGSDPVI | SEQ ID NO: 328 |
| 11A8 | SGSSSNIGSNPVN | SEQ ID NO: 337 |
| 4H5 | RASQSISSWLA | SEQ ID NO: 346 |
| 3G6-L2 | SGSSSNIGSNYVY | SEQ ID NO: 355 |
| 3B9 | RASQSVSRRYLA | SEQ ID NO: 364 |
| 3F9-L | SGSSSNIGSNTAN | SEQ ID NO: 373 |
| 3E10 | SGSSSNIGSNYVY | SEQ ID NO: 382 |
| 3C3 | RASQGINNFLA | SEQ ID NO: 391 |
| 11F4 | RASQSVSRSYLA | SEQ ID NO: 400 |
| 10E12 | SGSSSNIGNNYVS | SEQ ID NO: 409 |
| 4E1 | TGTSSDVGSYNLVS | SEQ ID NO: 418 |
| 2404.6H1 | RASQSVSRTYLA | SEQ ID NO: 427 |
| 2A8-K | KSSQSVLDSSNNNNYFA | SEQ ID NO: 436 |
| 3B1 | SGSSSNIGSNTVN | SEQ ID NO: 445 |
| 9B5 | RGSQGISNYLA | SEQ ID NO: 454 |
| 11A5 | GLSSGSVSTSYYPS | SEQ ID NO: 463 |
| 2D3 | GASTRAT | SEQ ID NO: 5 |
| 5A2 | GASSRAT | SEQ ID NO: 14 |
| 7F9 | AASTLQS | SEQ ID NO: 23 |
| 9D3 | GASSRAT | SEQ ID NO: 32 |
| 26C8 | GASSRAT | SEQ ID NO: 41 |
| 2A6.C5 | GASSRAT | SEQ ID NO: 50 |
| 5E12 | LGSNRAS | SEQ ID NO: 59 |
| 6D8 | DAFYRAT | SEQ ID NO: 68 |
| 8E11 | GASSRAT | SEQ ID NO: 77 |
| 5C1.A4 | LGSNRAS | SEQ ID NO: 86 |
| 9F7 | AASSLQS | SEQ ID NO: 95 |
| 2C3 | KASSLES | SEQ ID NO: 104 |
| 2G1 | AASSLQS | SEQ ID NO: 113 |

TABLE 1f-continued

Light Chain CDRs

| Clone | CDR1 VL Sequence | SEQ ID NO: |
|---|---|---|
| 3E4 | AASSLQS | SEQ ID NO: 122 |
| 3F2 | KASSLES | SEQ ID NO: 131 |
| 4F9 | AASSLQS | SEQ ID NO: 140 |
| 4G9 | AASSLQS | SEQ ID NO: 149 |
| 11H7 | AASSLQS | SEQ ID NO: 158 |
| 16H7 | KASSLES | SEQ ID NO: 167 |
| 17A2 | WASTRES | SEQ ID NO: 176 |
| 6H1 | AASSLQS | SEQ ID NO: 185 |
| 6H5 | AASSLQS | SEQ ID NO: 194 |
| 10D1 | AASSLQS | SEQ ID NO: 203 |
| 11F6 | KASTLES | SEQ ID NO: 212 |
| 6F8 | DNNKRPS | SEQ ID NO: 221 |
| 3G6-L1 | DNNKRPS | SEQ ID NO: 230 |
| 4C6 | GASSRAT | SEQ ID NO: 239 |
| 4E6 | GASSRAA | SEQ ID NO: 248 |
| 4H8 | SNNQRPS | SEQ ID NO: 257 |
| 9H12-K | TASSLQG | SEQ ID NO: 266 |
| 10G1-K | AASSLQS | SEQ ID NO: 275 |
| 11A3 | GASSRAT | SEQ ID NO: 284 |
| 3B11 | TNNQRPS | SEQ ID NO: 293 |
| 5G2 | SNNQRPS | SEQ ID NO: 302 |
| 11E4 | GASSRAT | SEQ ID NO: 311 |
| 2404.8E11 | SNNQRPS | SEQ ID NO: 320 |
| 10A2 | SNNQRPS | SEQ ID NO: 329 |
| 11A8 | SNNQRPS | SEQ ID NO: 338 |
| 4H5 | KASSLES | SEQ ID NO: 347 |
| 3G6-L2 | SNNQRPS | SEQ ID NO: 356 |
| 3B9 | GASSRAT | SEQ ID NO: 365 |
| 3F9-L | RNNQRPS | SEQ ID NO: 374 |
| 3E10 | SNNQRPS | SEQ ID NO: 383 |
| 3C3 | AASSLQS | SEQ ID NO: 392 |
| 11F4 | GASSRAT | SEQ ID NO: 401 |
| 10E12 | DNNKRPS | SEQ ID NO: 410 |
| 4E1 | EGSKRPS | SEQ ID NO: 419 |
| 2404.6H1 | GASSRAT | SEQ ID NO: 428 |
| 2A8-K | WASSRES | SEQ ID NO: 437 |
| 3B1 | TNNQRPS | SEQ ID NO: 446 |
| 9B5 | AASSLES | SEQ ID NO: 455 |
| 11A5 | STDTRSS | SEQ ID NO: 464 |
| 2D3 | CQQYNNWPLTF | SEQ ID NO: 6 |
| 5A2 | CQQYGTSPLTF | SEQ ID NO: 15 |
| 7F9 | CQKYNSVPLTF | SEQ ID NO: 24 |
| 9D3 | CQQYGTSPLTF | SEQ ID NO: 33 |
| 26C8 | CQQYGTSPLTF | SEQ ID NO: 42 |
| 2A6.C5 | CQQYGWSPITF | SEQ ID NO: 51 |
| 5E12 | CMQALEIPLTF | SEQ ID NO: 60 |
| 6D8 | CQHRSNWPITF | SEQ ID NO: 69 |
| 8E11 | CQQYDTSPLTF | SEQ ID NO: 78 |
| 5C1.A4 | CMQALQTPLTF | SEQ ID NO: 87 |
| 9F7 | CLQDYNYPYTF | SEQ ID NO: 96 |
| 2C3 | CQQYNSYSTF | SEQ ID NO: 105 |
| 2G1 | CLQDYNYPLTF | SEQ ID NO: 114 |
| 3E4 | CLQDYDYPLTF | SEQ ID NO: 123 |
| 3F2 | CQQYNSYSTF | SEQ ID NO: 132 |
| 4F9 | CLQDYDYPLTF | SEQ ID NO: 141 |
| 4G9 | CLQDYDYPLTF | SEQ ID NO: 150 |
| 11H7 | CQQADSFPFTF | SEQ ID NO: 159 |
| 16H7 | CQQYNSYSTF | SEQ ID NO: 168 |
| 17A2 | CQQYYGTSWTF | SEQ ID NO: 177 |
| 6H1 | CHQANSFPFTF | SEQ ID NO: 186 |
| 6H5 | CLQHNSYPRTF | SEQ ID NO: 195 |
| 10D1 | CLQYNSYPRTF | SEQ ID NO: 204 |
| 11F6 | CQQYNGYSTF | SEQ ID NO: 213 |
| 6F8 | CGTWDSSLSAVVF | SEQ ID NO: 222 |
| 3G6-L1 | CGTWDSSLSAVVF | SEQ ID NO: 231 |
| 4C6 | CQQYGTSPLTF | SEQ ID NO: 240 |
| 4E6 | CQQYGISPLTF | SEQ ID NO: 249 |
| 4H8 | CSAWDDSLNGYVF | SEQ ID NO: 258 |
| 9H12-K | CQQANVFPYTF | SEQ ID NO: 267 |
| 10G1-K | CLQHDSFPLTF | SEQ ID NO: 276 |
| 11A3 | CQQYDTSPLTF | SEQ ID NO: 285 |
| 3B11 | CAAWDDSLNGHVF | SEQ ID NO: 294 |
| 5G2 | CAAWDDSLNGHVF | SEQ ID NO: 303 |
| 11E4 | CQQYGTSPITF | SEQ ID NO: 312 |
| 2404.8E11 | CAAWDDSLNGYVF | SEQ ID NO: 321 |
| 10A2 | CAAWDDSLNGYVF | SEQ ID NO: 330 |

TABLE 1f-continued

Light Chain CDRs

| Clone | CDR1 VL Sequence | SEQ ID NO: |
|---|---|---|
| 11A8 | CSAWDDWLNGYVF | SEQ ID NO: 339 |
| 4H5 | CQQYNSYSRTF | SEQ ID NO: 348 |
| 3G6-L2 | CAAWDDSLSGWVF | SEQ ID NO: 357 |
| 3B9 | CQQFGTSPITF | SEQ ID NO: 366 |
| 3F9-L | CAAWDDSLNGYVF | SEQ ID NO: 375 |
| 3E10 | CAPWDDSLSGRVF | SEQ ID NO: 384 |
| 3C3 | CQHYNSYPITF | SEQ ID NO: 393 |
| 11F4 | CQQYSISPLTF | SEQ ID NO: 402 |
| 10E12 | CETWDSSLSAVVF | SEQ ID NO: 411 |
| 4E1 | CCSYAGSSTWVF | SEQ ID NO: 420 |
| 2404.6H1 | CQQYGTSPITF | SEQ ID NO: 429 |
| 2A8-K | CQQYYSTPYTF | SEQ ID NO: 438 |
| 3B1 | CSTWDDSLNGPVF | SEQ ID NO: 447 |
| 9B5 | CQQYYNYPITF | SEQ ID NO: 456 |
| 11A5 | CVLYMGSGISVF | SEQ ID NO: 465 |

The disclosure encompasses modifications to the DLL3 antibody agents comprising the sequences shown in Tables 1b to 1e, including functionally equivalent DLL3 antibody agents having modifications which do not significantly affect their properties and variants which have enhanced or decreased activity and/or affinity. For example, the amino acid sequence may be mutated to obtain a DLL3 antigen binding agent with a desired binding affinity to DLL3. Modification of polypeptides is routine practice in the art and need not be described in detail herein. Examples of modified polypeptides include polypeptides with conservative substitutions of amino acid residues, one or more deletions or additions of amino acids which do not significantly deleteriously change the functional activity, or which mature (enhance) the affinity of the polypeptide for its ligand, or use of chemical analogs.

Amino acid sequence insertions include amino- and/or carboxyl-terminal fusions ranging in length from one residue to polypeptides containing a hundred or more residues, as well as intrasequence insertions of single or multiple amino acid residues. Examples of terminal insertions include an antibody with an N-terminal methionyl residue or the antibody fused to an epitope tag. Other insertional variants of the antibody molecule include the fusion to the N- or C-terminus of the antibody of an enzyme or a polypeptide which increases the half-life of the antibody in the blood circulation.

Substitution variants have at least one amino acid residue in the antigen binding domain removed and a different residue inserted in its place. In some embodiments, sites of interest for substitutional mutagenesis include the hypervariable regions/CDRs, but FR alterations are also contemplated. Conservative substitutions are shown in Table 2 under the heading of "conservative substitutions." If such substitutions result in a change in biological activity, then more substantial changes, denominated "exemplary substitutions" in Table 2, or as further described below in reference to amino acid classes, may be introduced and the products screened.

TABLE 2

Amino Acid Substitutions

| Original Residue (naturally occurring amino acid) | Conservative Substitutions | Exemplary Substitutions |
|---|---|---|
| Ala (A) | Val | Val; Leu; Ile |
| Arg (R) | Lys | Lys; Gln; Asn; Ala |
| Asn (N) | Gln | Gln; His; Asp, Lys; Arg; Ala |
| Asp (D) | Glu | Glu; Asn; Ala |
| Cys (C) | Ser | Ser; Ala |
| Gln (Q) | Asn | Asn; Glu; Ala |
| Glu (E) | Asp | Asp; Gln; Ala |
| Gly (G) | Ala | Ala |
| His (H) | Arg | Asn; Gln; Lys; Arg; Ala |
| Ile (I) | Leu | Leu; Val; Met; Ala; Phe; Norleucine; Ala |
| Leu (L) | Ile | Norleucine; Ile; Val; Met; Ala; Phe |
| Lys (K) | Arg | Arg; Gln; Asn; Ala |
| Met (M) | Leu | Leu; Phe; Ile; Ala |
| Phe (F) | Tyr | Leu; Val; Ile; Ala; Tyr |
| Pro (P) | Ala | Ala |
| Ser (S) | Thr | Thr; Ala |
| Thr (T) | Ser | Ser; Ala |
| Trp (W) | Tyr | Tyr; Phe; Ala |
| Tyr (Y) | Phe | Trp; Phe; Thr; Ser; Ala |
| Val (V) | Leu | Ile; Leu; Met; Phe; Ala; Norleucine | i. Antibody Fragments

In one aspect, an anti-DLL-3 antibody agent according to any of the above embodiments can be an antibody fragment. An antibody fragment comprises a portion of an intact antibody, such as the antigen binding or variable region of the intact antibody. Antibody fragments include, but are not limited to, Fab, Fab', Fab'-SH, F(ab')$_2$, Fv, diabody, linear antibodies, multispecific formed from antibody fragments antibodies and scFv fragments, and other fragments described below. In some embodiments, the antibody is a full length antibody, e.g., an intact IgG1 antibody or other antibody class or isotype as described herein. (See, e.g., Hudson et al., Nat. Med., 9: 129-134 (2003); Pluckthun, The Pharmacology of Monoclonal Antibodies, vol. 113, pp. 269-315 (1994); Hollinger et al., Proc. Natl. Acad. Sci. USA, 90: 6444-6448 (1993); WO93/01161; and U.S. Pat. Nos. 5,571,894, 5,869,046, 6,248,516, and 5,587,458). A full length antibody, intact antibody, or whole antibody is an antibody having a structure substantially similar to a native antibody structure or having heavy chains that contain an Fc region as defined herein. Antibody fragments can be made by various techniques, including but not limited to proteolytic digestion of an intact antibody as well as production by recombinant host cells (e.g., E. coli or phage), as known in the art.

An Fv antibody fragment comprises a complete antigen-recognition and antigen-binding site. This fragment may comprise a dimer of one heavy- and one light-chain variable region domain in tight, non-covalent association. From the folding of these two domains emanate six hypervariable loops (three loops each from the H and L chain) that contribute the amino acid residues for antigen binding and confer antigen binding specificity to the antibody. However, even a single variable region (or half of an Fv comprising only three CDRs specific for an antigen) has the ability to recognize and bind antigen, although at a lower affinity than the entire binding site.

A diabody is a small antibody fragment prepared by constructing an sFv fragment with a short linker (e.g., about 5-10 residues) between the $V_H$ and $V_L$ domains such that interchain but not intra-chain pairing of the V domains is achieved, resulting in a bivalent fragment. Bispecific diabodies are heterodimers of two crossover sFv fragments in which the VH and VL domains of the two antibodies are present on different polypeptide chains (See, e.g., EP 404, 097; WO 93/11161; and Hollinger et al, Proc. Natl. Acad. Sci. USA, 90:6444-6448 (1993)).

Domain antibodies (dAbs), which can be produced in fully human form, are the smallest known antigen-binding fragments of antibodies, ranging from about 11 kDa to about 15 kDa. DAbs are the robust variable regions of the heavy and light chains of immunoglobulins (VH and VL, respectively). They are highly expressed in microbial cell culture, show favorable biophysical properties including, for example, but not limited to, solubility and temperature stability, and are well suited to selection and affinity maturation by in vitro selection systems such as, for example, phage display. dAbs are bioactive as monomers and, owing to their small size and inherent stability can be formatted into larger molecules to create drugs with prolonged serum half-lives or other pharmacological activities. (See, e.g., WO9425591 and US20030130496).

Fv and scFv are the species have intact combining sites that are devoid of constant regions. Thus, they may be suitable for reduced nonspecific binding during in vivo use. A single-chain Fv (sFv or scFv) is an antibody fragment that comprises the $V_H$ and $V_L$ antibody domains connected into a single polypeptide chain. The sFv polypeptide can further comprise a polypeptide linker between the VH and VL domains that enable the sFv to form the desired structure for antigen binding (See, e.g., Pluckthun, The Pharmacology of Monoclonal Antibodies, vol. 113, Rosenburg and Moore eds., Springer-Verlag, New York, pp. 269-315 (1994); Borrebaeck 1995, infra. scFv fusion proteins can be constructed to yield fusion of an effector protein at either the amino or the carboxy terminus of an sFv. The antibody fragment also can be a "linear antibody (See, e.g., U.S. Pat. No. 5,641, 870). Such linear antibody fragments can be monospecific or bispecific. Exemplary DLL3 specific scFvs are provided in Table 1d.

TABLE 1d

Exemplary DLL3 specific scFvs

| Clone | scFv Sequence | SEQ ID NO: |
|---|---|---|
| 2D3 | QVQLQESGPGLVKPSETLSLTCTVSDNSISNYYWSWIRQPPGKGLE WIAYIYYSGTTNYNPSLKSRVTISLDTSKNQFSLKLSSVTAADTAVY YCARLFNWGFAFDIWGQGTMVTVSSGGGGSGGGGSGGGGSGGGG SEIVMTQSPATLSVSPGERATLSCRASQSVSSNLAWYQQKPGQAPRL LIYGASTRATGIPARFSGSGSGTEFTLTISSLQSEDFAVYYCQQYNNW PLTFGGGTKVEIK | SEQ ID NO: 9 |
| 5A2 | QVQLQESGPGLMKPSETLSLTCTVSGGSISSSYWSCIRQPPGKGLEWI GYIYYSGTTNYNPSLKSRVTLSLDTSKNQFSLRLTSVTAADTAVYYC ARVAPTgFWFDYWGQGTLVTVSSGGGGSGGGGSGGGGSGGGGSEI VLTQSPGTLSLSPGERATLSCRASQRVSSRYLAWYQQKPGQAPRLLI YGASSRATGIPDRFSGSGSGTDFTLTISRLEPEEFAVYYCQQYGTSPL TFGGGTKVEIK | SEQ ID NO: 18 |
| 7F9 | EVQLVESGGGLVQPGGSLRLSCAASGFTFSSHDMHWVRQATGKGL EWVSAIGIAGDTYYSGSVKGRFTISRENAKNSLYLQMNSLRAGDTA VYYCARANWGeGAFDIWGQGTMVTVSSGGGGSGGGGSGGGGSGG GGSDIQMTQSPSSLSASVGDRVTITCRASQGISDYLAWYQQKPGKIP KLLIYAASTLQSGVPSRFSGSGSGTDFTLTISSLQPEDVATYYCQKYN SVPLTFGGGTKVEIK | SEQ ID NO: 27 |
| 9D3 | QVQLQESGPGLVKPSETLSLTCTVSDDSISNYYWSWIRQPPGKGLE WIGYIFYSGTTNHNPSLKSRLTISLDKAKNQFSLRLSSVTAADTAVY YCARVFNWgFAFDIWGQGTMVTVSSGGGGSGGGGSGGGGSGGGG SEIVLTQSPGTLSLSPGERATLSCRASQRISRTYLAWYQQKPGQAPRL LIYGASSRATGIPDRFTGSGSGTDFTLTISRLEPEDFAVYYCQQYGTS PLTFGGGTKVEIN | SEQ ID NO: 36 |
| 26C8 | QVQLQESGPGLVKPSETLSLTCTVSDNSISNYYWSWIRQPPGKGLE WIAYIYYSGTTNYNPSLKSRVTISLDTSKNQFSLQLSSVTAADAAVY YCARVFHWgFAFDIWGQGTMVTVSSGGGGSGGGGSGGGGSGGGG SEIVLTQSPGTLSLSPGERATLSCRASQRVSNTYLAWYQQNPGQAPR LLIYGASSRATGIPDRFSGSGSGTDFTLTISRLEPEDFAVYYCQQYGT SPLTFGGGTKVEIK | SEQ ID NO: 45 |
| 2A6.C5 | QVQLQESGPGLVKPSETLSLTCTVSNVSISSYYWSWIRQPPGKGLEW IGYIYYSGTTNYNPSLKSRVTMSVDTSKNQFSLKLSSVTAADTAVYF CARLSNWgFAFDIWGQGTMVTFSSGGGGSGGGGSGGGGSGGGSEI VLTQSPGTLSLSPGERATLSCRASQTISSSYLAWYQQKPGQAPRLLIY GASSRATGIPDRFSGSGSGTEFTLTISRLEPEDFAVYYCQQYGWSPIT FGQGTRLEIK | SEQ ID NO: 54 |
| 5E12 | EVQLVESGGGLVQPGGSLRLSCAASGFTFSSYDMHWVRQATGKGL EWVSAIGPAGDTYYPGSVKGRFTISRENAKNSLYLQMNSLRAGDTA VYYCARADPPyyyYGMDVWGQGTTVTVSSGGGGSGGGGSGGGGSG GGSDIVMTQSPLSLPVTPGEPASISCRSSQSLLHSNEYNYLDWYLQ KPGQSPQLLIYLGSNRASGVPDRFSGSGSGTDFILKISRVEAEDVGVY YCMQALEIPLTFGGGTKVEIK | SEQ ID NO: 63 |

TABLE 1d-continued

Exemplary DLL3 specific scFvs

| Clone | scFv Sequence | SEQ ID NO: |
|---|---|---|
| 6D8 | QITLKESGPTLVKPTQTLTLTCTFSGFSLSTrgVGVGWIRQPPGKALE<br>WLALIYWNDDKRYSPSLQTRLTITKDTPKNQVVLTMTNMDPVDTA<br>TYYCARSNWGnWYFALWGRGTLVTVSSGGGGSGGGGSGGGGSGG<br>GGSEIVLTQSPATLSLSPGERATLSCRASQSVSSYLAWYQQKPGQAP<br>RLLIYDAFYRATGIPARFSGSGSTDFTLTISSLEPEDFAVYYCQHRS<br>NWPITFGQGTRLEIK | SEQ ID NO: 72 |
| 8E11 | QVQLQESGPGLVKPSETLSLTCTVSGDSISNYYWTWIRQPPGKGLE<br>WIGYIYYSGTTNSNPSLKSRVTVSLDTSKSQFSLNLSSVTAADTAVY<br>YCARVFNRgFAFDIWGQGTMVTVSSGGGGSGGGGSGGGGSGGGGS<br>EIVLTQSPGTLSLSPGERATLSCRASQRISNTYLAWYQQKPGQAPRL<br>LIYGASSRATGIPDRFSGSGSGTDFTLTISRLEPEDFAAYYCQQYDTS<br>PLTFGGGTKVEIK | SEQ ID NO: 81 |
| 5C1.A4 | QVTLRESGPALVKPTQTLTLTCTVSGVSLSTsgMCVSWIRQPLGKAL<br>EWLGFIDWDDDKYYNTSLKTRLTISKDTSKNQVVLTMTNMDPVDT<br>ATYYCARIRGYsgsyDAFDIWGQGTVVIVSSGGGGSGGGGSGGGGSG<br>GGGSDIVMTQSPLSLPVTPGEPASISCRSSQSLLHSNGYNHLDWYLQ<br>KPGQSPQVLIYLGSNRASGVPDRFSGSGSGTDFTLKISRVEAEDVGV<br>YFCMQALQTPLTFGGGTKVEIK | SEQ ID NO: 90 |
| 9F7 | QVQLQVSGPGLVKPSETLSLTCSVSGGSISSYYWSWIRQSPGKGLD<br>WIGYMYYSGTTNYNPSLKSRVTISVDTSKNQFSLKLSSVTATDTAV<br>YYCARVGLTgFFFDYWGQGTLVTVSSGGGGSGGGGSGGGGSGGGG<br>SAIQMTQSPSSLSASVGDRVTITCRASQGIRNDLGWYQQKPGKAPKL<br>LIYAASSLQSGVPSRFSGSGSGTDFTLTVSSLQPEDFATYYCLQDYN<br>YPYTFGQGTKLEIK | SEQ ID NO: 99 |
| 2C3 | QVQLQQWGGGLLKPSETLSLTCAVYGGSSSGNYWSWIRQPPGKRL<br>EWIGEINHSGTTSYNPSLKSRVTISVDTSKNQFSLKLSSVTAADTAVY<br>YCARGELGIADSWGQGTLVTVSSGGGGSGGGGSGGGGSGGGGSDI<br>QMTQSPSTLSASVGDRVTITCRASQSISRWLAWYQQKPGKAPKLLIY<br>KASSLESGVPSRFSGSGSGTEFTLTISSLQPDDFATYYCQQYNSYSTF<br>GQGTKVEIK | SEQ ID NO: 108 |
| 2G1 | QLQLQESGPGLVKPSETLSLTCTVSGGSISSssYYWGWIRQPPGKGLE<br>WIGSIYYSGNIYHNPSLKSRVSISVDTSKNQFSLRLSSVTAADTAVY<br>CAREIIVgaTHFDYWGQGTLVTVSSGGGGSGGGGSGGGGSGGGGSA<br>IQMTQSPSSLSASVGDRVTITCRASQGIRNDLGWYQQKPGKAPELLI<br>YAASSLQSGVPSRFSGSGSGTDFTLTISSLQPEDFATYYCLQDYNYPL<br>TFGPGTKVDIK | SEQ ID NO: 117 |
| 3E4 | QVQLQQWGAGLLKPSETLSLTCAVYGGSFSGYYWSWIRQPPGKGL<br>EWIGEIIHSGSSNYNPSLKSRVSISVDTSKNQFSLKLSSVTAADTAVY<br>YCSRGEYGsgSRFDYWGQGTLVTVSSGGGGSGGGGSGGGGSGGGG<br>SAIQMTQSPSSLSASVGDRVAITCRASQGIRDDLGWYQQKPGKAPK<br>LLIYAASSLQSGVPSRFSGSRSDTDFTLTISSLQPEDFATYYCLQDYD<br>YPLTFGGGTKVEIK | SEQ ID NO: 126 |
| 3F2 | QVQLQESGPGLVKPSGTLSLTCAVSGGSISSnNWWSWVRQPPGKGL<br>EWIGDIHHSGSTNYKPSLKSRVTISVDKSKNQFSLNLISVTAADTAV<br>YYCAREAGGYFDYWGQGILVTVSSGGGGSGGGGSGGGGSGGGGS<br>DIQMTQSPSTLSASVGDRVTITCRASQSISSWLAWYQQKPGKAPKLL<br>ISKASSLESGVPSRFSGSGSGPEFTLTISSLQPADFATYYCQQYN-<br>SYST<br>FGQGTKLEIK | SEQ ID NO: 135 |
| 4F9 | QVQLQQWGAGLLKPSETLSLTCAVYGGSFSGYYWTWIRQPPGKGL<br>EWIGEITHSGSTNYNPSLKSRVSISVDTSKNQFSLKLSSVTAADTAVY<br>YCARGEYGsgSRFDYWGQGTLVTVSSGGGGSGGGGSGGGGSGGGG<br>SAIQMTQSPSSLSASVGDRVAITCRASQGIRDDLGWYQQKPGKAPK<br>LLIYAASSLQSGVPSRFSGSGSDTDFTLTISSLQPEDFATYYCLQDYD<br>YPLTFGGGTKVEIK | SEQ ID NO: 144 |
| 4G9 | QVQLQQWGAGLLKPSETLSLTCAVYGGSFSGYYWSWIRQPPGKGL<br>EWIGEITHSGSTNYNPSLKSRVSISVDTSKNQFSLKLSSVTAADTAVY<br>YCARGEYGsgSRFDYWGQGTLVTVSSGGGGSGGGGSGGGGSGGGG<br>SAIQMTQSPSSLSASVGDRVALTCRASQGIRDDLGWYQQKPGKAPK<br>LLIYAASSLQSGVPSRFSGSGSDTDFTLTISSLQPEDFATYYCLQDYD<br>YPLTFGGGTKVEIK | SEQ ID NO: 153 |
| 11H7 | QVQLQQWGAGLLKPSETLSLTCAVYGGSFSAYYWNWIRQPPGKGL<br>EWIGEINHSGSTNYNPSLKSRVTISVDTSKNQFSLNLTSLTAADTAV<br>YYCARGLDSsgwYPFDYWGQGTLVTVSSGGGGSGGGGSGGGGSGG<br>GGSDIQMTQSPSSVSASVGDRVTITCRASQGISSWLAWYQQKPGKA | SEQ ID NO: 162 |

TABLE 1d-continued

Exemplary DLL3 specific scFvs

| Clone | scFv Sequence | SEQ ID NO: |
|---|---|---|
| | PKLLIYAASSLQSGVPSRFSGSGSGTDFTLTISSLQPEDFATYYCQQA<br>DSFPFTFGPGTKVDIK | |
| 16H7 | QVQLQQWGAGLLKPSETLSLTCAVFGGSFSGDYWSWIRQPPGKGLE<br>WIGEINHSGITSFNPSLKSRVTISVDTSKNQFSLKLSSVTAADTAVYY<br>CARGELGIPDNWGQGTLVTVSSGGGGSGGGGSGGGGSGGGGSDIQ<br>MTQSPSTLSASVGDRVTITCRASQSISRWLAWYQQKPGKAPKLLIYK<br>ASSLESGVPSRFSGSGSGTEFTLTISSLQPDDFATYYCQQYNSYSTFG<br>QGTKVEIK | SEQ ID NO: 171 |
| 17A2 | QVQLQESGPGLVKPSGTLSLTCVVFGDSISSsNWWSWVRQPPGKGL<br>EWIGEVPHSGSTNYNPSLKSRVTISVDKSKNQFSLKLSSVTAADTAV<br>YYCARAAVAGALDYWGQGTLVTVSSGGGGSGGGGSGGGGSGGGG<br>SDIVMTQSPDSLAVSLGERATINCKSSQSVLYSSNNKnYLAWYQQKP<br>GQPPNLLVYWASTRESGVPDRFSGAGSGTDFTLTISSLQAEDVAVY<br>YCQQYYGTSWTFGQGTKVEIK | SEQ ID NO: 180 |
| 6H1 | QITLRESGPTLVKPTQTLTLTCTFSGFSLSTsgLGVGWIRQPPGEALE<br>WLALIYWNDDKRYSPSLKSRLSITKDTSKNQVVLIMTNMDPVDTAT<br>YYCVHRRIAaPGSVYWGQGTLVTVSSGGGGSGGGGSGGGGSGGGG<br>SDIQMTQSPSSVSASVGDRVTITCRASQGISSWLAWYQQKPGKAPK<br>LLISAASSLQSGVPSRFSGSGSGTDFTLTISSLQPEDFATYY-<br>CHQANSF<br>PFTFGQGTKLEIK | SEQ ID NO: 189 |
| 6H5 | QVQLVQSGAEVKKPGASVKVSCKVSGYTLTELSMHWVRQAPGKG<br>PEGMGGFDpEDGKTIYAQKFQGRVTMTEDTSADTAYMELNSLRSE<br>DTAVYYCATLLRGIDAFDVWGQGTMVTVSSGGGGSGGGGSGGGG<br>SGGGGSDIQMTQSPSSLSASVGDRVTITCRASQGIRNDLGWYQQKP<br>GKAPKRLIYAASSLQSGVPSRFSGSGSGTEFTLTISTLQPEDFATYYC<br>LQHNSYPRTFGQGTKVEIK | SEQ ID NO: 198 |
| 10D1 | QVQLQQWGAGLLKPSETLSLTCAVYGGSFSGYYWRWIRQPPGKGL<br>EWIGEISHSGSTNYNPSLKSRVTISVDTSKNQFSLKLSSVTAADTAVY<br>YCAVRGYSygyPLFDYWGQGTLVTVSSGGGGSGGGGSGGGGSGGG<br>GSDIQMTQSPSSLSASVGDRVTITCRASQGIRNDLGWYQQKLGKAP<br>KRLIYAASSLQSGVPSRFSGSGSGTEFTLTISSLQPEDFATYYCLQYN<br>SYPRTFGQGTKVEIK | SEQ ID NO: 207 |
| 11F6 | QVQLQESGPGLVKPSGTLSLTCAVSGDSISSNWWTWVRQPPGKGLE<br>WIGDIHHSGSTNYNPSLKSRVTMSVDKSENQFSLKLSSVTAADTAVF<br>YCARDGGGTLDYWGQGTLVTVSSGGGGSGGGGSGGGGSGGGGSD<br>IQMTQSPSTLSASVGDRVTITCRASQSISSWLAWYQQKPGKAPKLLI<br>YKASTLESGVPSRFSGSGSGTEFTLTISSLQPDDFATYYCQQYNGYST<br>FGQGTKVEIK | SEQ ID NO: 216 |
| 6F8 | QVQLVQSGAEVKKPGSSVKVSCKASGGTFTNYCISWVRQAPGQGL<br>EWMGGIIpIFGTTNYAQTFQGRVTITADKSTSTAYMELSSLRSEDTA<br>VYYCARDNGDryyYDMDVWGQGTTVTVSSGGGGSGGGGSGGGGS<br>GGGGSQSVLTQPPSVSAAPGQKVTISCGSSSNIGNNYVSWYQQLPG<br>TAPKLLIYDNNKRPSGIPDRFSGSKSGTSATLGITGLQTGDEADYYC<br>GTWDSSLSAVVFGGGTKLTVL | SEQ ID NO: 225 |
| 3G6-L1 | QVPLVQSGAEVKKPGSSVKVSCKASGGTFSTYSISWVRQAPGQGLE<br>WMGGIIpIFGTTNYAQKFQGRVTITADKSTSTAYMELSSLRSEDTAV<br>YYCARDGEGsyyyyYGMDVWGQGTTVTVSSGGGGSGGGGSGGGGS<br>GGGGSQSVLTQPPSVSAAPGQKVTISCGSSSNIGNNYVSWYQQLPG<br>TAPKLLIYDNNKRPSGIPDRFFGSKFGTSATLGITGLQTGDEADYYC<br>GTWDSSLSAVVFGGGTKLTVL | SEQ ID NO: 234 |
| 4C6 | QVQLQESGPGLVKPSETLSLTCTVSGDSISSYYWSWIRQPPGKGLEW<br>IGYMYYSGITNYNPSLKSRVNISLDTSKNQFSLKLGSVTAADTAVYY<br>CARLSVAgFYFDYWGQGTLVTVSSGGGGSGGGGSGGGGSGGGGSE<br>IVLTQSPGTLSLSPGERATLSCRASQSVTRSYLAWYQQKPGQAPRLL<br>IYGASSRATDIPDRFSGSGSGTDFTLTINRLEPEDFAVYYCQQYGTSP<br>LTFGGGTKVEIK | SEQ ID NO: 243 |
| 4E6 | QVQLQESGPGLVKPSETLSLTCTVSSDSISSYYWSWIRQPPGKGLEW<br>ISYIYYSGISNYNPSLKSRVSISVDTSKNQFSLRLSSVTAADTAVYYC<br>ARISVAgFFFDNWGQGTLVTVSSGGGGSGGGGSGGGGSGGGGSEIM<br>LTQSPDTLSLSPGERATLSCRASQSVSSSYLAWYQQKPGQAPRLLIY<br>GASSRAAGVPDRFSGSGSGTDFTLTISRLAPEDFVVYYCQQYGISPLT<br>FGGGTKVEIK | SEQ ID NO: 252 |

TABLE 1d-continued

Exemplary DLL3 specific scFvs

| Clone | scFv Sequence | SEQ ID NO: |
|---|---|---|
| 4H8 | QVQLQQSGPGLVKPSQTLSLTCAISGDSVSSnsATWNWIRQSPSRGLE WLGRTYYRSKwyDDYAVSVKSRITINPDTSKNHLSLHLNSVTPEDTA VYYCAGGGLVgapDGFDVWGQGTMVTVSSGGGGSGGGGSGGGGS GGGGSQSVLTQPPSASGTPGQRVTISCSGSSSNIGSDPVNWYQQLPG TAPKLLIYSNNQRPSGVPDRFSGSKSGTSASLAISGLQSEDEADYYCS AWDDSLNGYVFGTGTKVTVL | SEQ ID NO: 261 |
| 9H12-K | QVQLVQSGAEVKKPGASVKVSCKASGYTFTGYSIHWVRQAPGQGL EWMGWINpNSGGTFYAQKFQGRVTMTRDTSISTVYMELSRLRSDD TAVYYCARDGWGdyyyYGLDVWGQGTTVTVSLGGGGSGGGGSGGG GGSGGGGSDIQMTQSPSSVSASVGDRVTITCRASQDISSWLAWYQQ KPGKAPKLLIYTASSLQGGVPSRFSGSGSTDFTLTISSLQPEDLATY SCQQANVFPYTFGQGTKLEIK | SEQ ID NO: 270 |
| 10G1-K | EVQLLESGGGLVQPGGSLRLSCAASGFTFSSYAMNWVRQAPGKGL EWVSTISgSGGSTYYADSVKGRFTISRDNSKNTLYLQMNSLRAEDTA VFYCAIDPEYydilTGGDYWGQGTLVTVSSGGGGSGGGGSGGGGS GGGGSDIQMTQSPSAMSASVGDRVTITCRASQGISNYLAWFQQKPG KVPKRLIYAASSLQSGVPSRFSGSGSGTEFTLTISSLQPEDFA- TYFCLQ HDSFPLTFGGGTKVEIK | SEQ ID NO: 279 |
| 11A3 | QVQLQESGPGLVKPSETLSLTCTVSSDSISNYYWSWIRQPPGKGLEW ISYIYYSGITNYNPSLKSRVTISVDTSKNQFSLKLSSVTAADTAVYYC ARITVTgFYFDYWGQGTLVTVSSGGGGSGGGGSGGGGSGGGGSEIV LTQSPGTLSLSPGERATLSCRASQSISRSYLAWYQQKPGQAPRHLIY GASSRATGIPDRFSGSGSGTDFILTISRLEPEDFAVYYCQQYDT- SPLTF GGGTKVEIK | SEQ ID NO: 288 |
| 3B11 | QVQLQQSGPGLVKPSQTLSLTCAISGDSVSSnsVVWNWIRQSPSRGL EWLGRTYYRSKwyDDYAVSVKSRITINPDTSKNQFSLQLNSVTPEDT AVYHCARGGIVgapDAFDIWGQGTMVTVSSGGGGSGGGGSGGGGS GGGGSQSVLTQPPSASGTPGQRVTISCSGSSSNIGSDPVSWYQQFPGT APKLLIYTNNQRPSGVPDRFSGSKSGTSASLAISGLQSEDEADYYCA AWDDSLNGHVFGTGTKVTVL | SEQ ID NO: 297 |
| 5G2 | QVQLQQSGPGLVKPSQTLSLTCAISGDSVSSnsAVWNWIRQSPSRGL EWLGWTYYRSKYYndYAVSLKSRITINPDTSKNQFSLQLNSLTPEDT AVYYCTRGGIVgapDGFDVWGQGTMVTVSSGGGGSGGGGSGGGGS GGGGSQSALTQPPSASGTPGQRVTISCSGSNSNIGSNPINWYQQLPGT APKLLIYSNNQRPSGVPDRFSGSKSGTSASLAISGLQSEDEADYYCA AWDDSLNGHVFGTGTKVTVL | SEQ ID NO: 306 |
| 11E4 | QVQLQESGPGLVKPSETLSLTCTVSGGSISSYYWSWIRQSPGKGLEW IGYVYYSDITNYNPSLKSRVTISVDTSKNQFSLNLNSVTAADTAFYF CARIGVAgFYFDYWGQGTLVTVSSGGGGSGGGGSGGGGSGGGGSEI VLTQSPDTLSLSPGERATLSCRASQSVSRRYLAWYQQKPGQAPRLLI YGASSRATGIPDRFSGSGSGTDFTLTISRLEPEDFEVYYCQQYGT- SPIT FGQGTRLEIK | SEQ ID NO: 315 |
| 2404.8E11 | QIQLQQSGPGLVKPSQTLSLTCAISGDSVSSnsAVWNWIRQSPSRGLE WLGRTYYRSKwyNDYAVSVKSRITIKPDTAKNQFSLQLNSVTPEDT AVYYFTRGGIVgapDAFDIWGQGTMVTVSSGGGGSGGGGSGGGGSG GGGSQSVLTQPPSASGTPGQRVTISCSGSSSNIGSDPINWYQQVPGTA PKLLIYSNNQRPSGVPDRFSGSKSGTSASLAISGLQSEDEADYYCAA WDDSLNGYVFGTGTKVTVL | SEQ ID NO: 324 |
| 10A2 | QVQLQQSGPGLVKPSETLSLTCAISGDSVSSnsATWNWIRQSPSRGLE WLGRTYYRSEwyNDYAVSVKSRITINPDTSKNHLSLHLNSVTPEDTA VYYCAGGGIVgapDGFDVWGQGTMVTVSSGGGGSGGGGSGGGGSG GGGSQSVLTQPPSASGTPGQRVTISCSGSSSNIGSDPVIWYQQLPRTA PKLLIYSNNQRPSGVPDRFSGSKSGTSASLAISGLQSEDEADYYCAA WDDSLNGYVFGTGTKVTVL | SEQ ID NO: 333 |
| 11A8 | QVQLQQSGPGLVKPSQTLSLTCAISGDSVSSnsATWNWIRQSPSTGLE WLARTYYRSKwyNDYEVSVKSQITINPDTSKNQFSLQLNSVTPEDTA VYYCARGGIVgapDAFDIWGQGTMVTVSSGGGGSGGGGSGGGGSG GGGSQSVLTQPPSASGTPGQVTISCSGSSSNIGSNPVNWYQQLPGT APKLLIYSNNQRPSGVPDRFSDSKSGTSASLAISGLQSEDEADYYCSA WDDWLNGYVFGTGTKVTVL | SEQ ID NO: 342 |
| 4H5 | QVQLQESGPGLVKPSETLSLTCTVSGDSINNYFWSWIRQPPGKGLE WIGYFYHRGGNNYNPSLKSRVTISIDTSKNQFSLNLNSVTSADTAVY YCARLALAgFFFDYWGQGTLVTVSSGGGGSGGGGSGGGGSGGGGS | SEQ ID NO: 351 |

TABLE 1d-continued

Exemplary DLL3 specific scFvs

| Clone | scFv Sequence | SEQ ID NO: |
|---|---|---|
|  | DIQMTQSPSTLSASVGDRVTITCRASQSISSWLAWYQQKPGKAPKLL<br>IYKASSLESGVPSRFSGSGSGTEFTLTISSLQPDDFATYYCQQYNSYS<br>RTFGQGTKVEIK |  |
| 3G6-L2 | QVPLVQSGAEVKKPGSSVKVSCKASGGTFSTYSISWVRQAPGQGLE<br>WMGGIIpIFGTTNYAQKFQGRVTITADKSTSTAYMELSSLRSEDTAV<br>YYCARDGEGsyyyyYGMDVWGQGTTVTVSSGGGGSGGGGSGGGGS<br>GGGGSQSVLTQPPSASGTPGQRVTISCSGSSSNIGSNYVYWYQQLPG<br>TAPKLLIYSNNQRPSGVPDRFSGSKSGTSASLAISGLRSEDEADYYCA<br>AWDDSLSGWVFGGGTKLTVL | SEQ ID NO: 360 |
| 3B9 | EVQLVESGGGLVQPGGSLRLSCAASGFTFSSYSMNWVRQAPGKGLE<br>WVSYISsSSSTIYYADSVKGRFTISRDNAKNSLYLQMNSLRDEDTAV<br>YYCARDKERryyyYGMDVWGQGTTVTVSSGGGGSGGGGSGGGGSG<br>GGGSEIVLTQSPDTLSLSPGERATLSCRASQSVSRRYLAWYQQKPGQ<br>APRLLIYGASSRATGIPDRFSGSGSGTDFTLTISRLEPEDFAVYYCQQ<br>FGTSPITFGQGTRLEIK | SEQ ID NO: 369 |
| 3F9-L | QVQLQQSGPGLVKPSQTLSLACAISGDSVSSnsAIWNWIRQSPSRGLE<br>WLGGTYYRSMwyNDYAVSVKSRITINPDTSKNQLSLQLNSVTPEDT<br>AVYYCSRGGIVgvpDAFDIWGQGTMVTVSSGGGGSGGGGSGGGGS<br>GGGGSQSVLTQPPSASGTPGQRVTISCSGSSSNIGSNTANWYQQLPG<br>TAPRLLIYRNNQRPSGVPDRFSGSKSGTSASLAISGLQSEDEADYYC<br>AAWDDSLNGYVFGTGTKVTVL | SEQ ID NO: 378 |
| 3E10 | QVQLQESGPGLVKPSETLSLTCNVSDGSISSYYWTWIRQPPGKGLD<br>WIGYIFYSGTTNYNPSLKSRVTISLDTSKNQFSLKLTSMTAADTAVY<br>YCARISEKsFYFDYWGQGTLVTVSSGGGGSGGGGSGGGGSGGGGS<br>QSVLTQPPSASGTPGQRVTISCSGSSSNIGSNYVYWYQQLPGTAPKL<br>LIYSNNQRPSGVPDRFSGSKSGTSASLAISGLRSEDEADYYCAPWDD<br>SLSGRVFGGGTKLTVL | SEQ ID NO: 387 |
| 3C3 | QVQLVQSGAEVKRPGASVKVSCKASGYTFTSYYIHWVRQAPGQGL<br>EWMGVIVpSGGSISYAQKFQGRVTMTRDTSTNIVYMELSSLRSEDT<br>AVYYCARDRYYgdyyYGLDVWGQGTTVTVSSGGGGSGGGGSGGGG<br>SGGGGSDIQMTQSPSSLSASVGDRVTITCRASQGINNFLAWFQQKPG<br>KAPKSLIYAASSLQSGVPSKFSGSGSGTDFTLTIRSLQPEDFATYYCQ<br>HYNSYPITFGQGTRLEIK | SEQ ID NO: 396 |
| 11F4 | QVHLQESGPGLVKPSETLSLTCTVSGGSISHYYWTWIRQPPGKGLE<br>WIGYIYYSGITNFSPSLKSRVSISVDSSKNQFSLNLNSVTAADTAVYY<br>CAGISLAgFYFDYWVQGTLVTVSSGGGGSGGGGSGGGGSGGGGSEI<br>VLTQSPGTLSLSPGERATLSCRASQSVSRSYLAWYQQKPGQAPRLLI<br>YGASSRATGVPDRFSGSGSGTDFTLTISRLEPEDFAVFYCQQYSISPL<br>TFGGGTKVEIK | SEQ ID NO: 405 |
| 10E12 | QVQLQESGPGLVKPSETLSLTCTVSGVSISSYYWSWIRQPPGKGLEW<br>IAYIYYSGNTNYSPSLKSRVTISVDTSKDQLSLKLSSVTAADTAVYY<br>CTRGGSGtiDVFDIWGQGTMVAVSSGGGGSGGGGSGGGGSGGGGS<br>QSVLTQPPSVSAAPGQKVTISCSGSSSNIGNNYVSWYQQLPGTAPKL<br>LIYDNNKRPSGIPDRFSGSKSGTSATLGITGLQTGDEADYYCETWDS<br>SLSAVVFGGGTKLTVL | SEQ ID NO: 414 |
| 4E1 | QVQLQQSGPGLVKPSQTLSLTCAISGDNVSTnsAAWNWIRQSPSRGL<br>EWLGWTYYRSKwyNDYAVSLKSRININPDTSKNQFSLQLNSVTPED<br>TAVYYCARWVNRDVFDIWGQGTMVTVSSGGGGSGGGGSGGGGSG<br>GGGSQSALTQPASVSGSPGQSITISCTGTSSDVGSYNLVSWYQQHPG<br>KAPKLMIYEGSKRPSGVSNRFSGSKSGNTASLTISGLQAEDEADYYC<br>CSYAGSSTWVFGGGTKLTVL | SEQ ID NO: 423 |
| 2404.6H1 | QVQLVESGGGVVQPGRSLRLSCAASGFTFSSYGMHWVRQTPGKGL<br>EWVAVISYDGNsNYYADSVKGRFTISRDNSKNTLYLQMNSLRAEDT<br>AVYYCARDGATvtsyyyYGMDVWGQGTTVTVSSGGGGSGGGGSG<br>GGSGGGGSEIVLTQSPGTLSLSPGERATLSCRASQSVSRTYLAWYHQ<br>KPGQAPRLLIYGASSRATGISDRFSGSGSGTDFTLTISRLEPEDFAVY<br>YCQQYGTSPITFGQGTRLEIK | SEQ ID NO: 432 |
| 2A8-K | QVQLQQSGPGLVKPSQTLSLTCAISGDSVSSnsAVWNWIRQSPSRGL<br>EWLGRTYYRSKwyNDYAVSVKSRITINPDTSRNQFSLQLNSVTPEDT<br>AVYYCARGGIVgapDGFDIWGQGTMVTVSSGGGGSGGGGSGGGGS<br>GGGGSDIVMTQSPDSLAVSLGERATINCKSSQSVLDSSNNNnYFAW<br>YQQRPGQPPHLLIYWASSRESGVPDRFSGSGSGTDFTLTISSLQAEDV<br>AVYYCQQYYSTPYTFGQGTKLEIK | SEQ ID NO: 441 |

TABLE 1d-continued

Exemplary DLL3 specific scFvs

| Clone | scFv Sequence | SEQ ID NO: |
|---|---|---|
| 3B1 | QVQLQQSGPGLVKPSQTLSLTCAISGDSVSSntTAWKWSRQSPSKGL<br>EWLGWTYYRSKwyYDYTVSVKSRITINPDTSKNQFSLQLNSVTPEDT<br>AVYYCARWIPHDAFDIWGQGTMVTVSSGGGGSGGGGSGGGGSGG<br>GGSQSALTQPPSASGTPGQRVTISCSGSSSNIGSNTVNWYQQLPGTA<br>PKLLIYTNNQRPSGVPDRFSGSKSGTSASLAISGLQSEDEADYFCSTW<br>DDSLNGPVFGGGTKLTVL | SEQ ID NO: 450 |
| 9B5 | QVQLQESGPGLVKPSETLSLTCTVSGDSISSLSWSWIRQTPGEGLEWI<br>GYLYYSGSTDYNPSLKSRVTISVDTSKNQFSLKLRSVAAADTALYY<br>CARGRRAFDIWGQGTMVTVSSGGGGSGGGGSGGGGSGGGGSDIQ<br>MTQSPSSLSASVGDRVTITCRGSQGISNYLAWFQQRPGKAPKSLIYA<br>ASSLESGVPSKFSGSGSGTDFTLTIISLQPEDFATYYCQQYYNYP-<br>ITFG<br>QGTRLEIK | SEQ ID NO: 459 |
| 11A5 | QVQLVQSGAEVKKPGASVKVSCKASGYTFTGYYMHWVRQAPGQG<br>LEWMGWINpNSGGTNYAQKFQGRVTMTRDTSVSTAYMELSRLTSD<br>DTAIYYCAKDGGGdfyfYGMDVWGQGTTVTVSSGGGGSGGGGSGG<br>GGSGGGGSQTVVTQEPSFSVSPGGTVTLTCGLSSGSVSTSYYPSCFQ<br>QTPGQAPRTLIYSTDTRSSGVPDRFSGSILGNKAALTITGAQADDESD<br>YYCVLYMGSGISVFGGGTKLTVL | SEQ ID NO: 468 |
| 10G1-K | EVQLLESGGGLVQPGGSLRLSCAASGFTFSSYAMNWVRQAPGKGL<br>EWVSTISgSGGSTYYADSVKGRFTISRDNSKNTLYLQMNSLRAEDTA<br>VFYCAIDPEYydilTGGDYWGQGTLVTVSSGGGGSGGGGSGGGGSG<br>GGGSDIQMTQSPSAMSASVGDRVTITCRASQGISNYLAWFQQKPGK<br>VPKRLIYAASSLQSGVPSRFSGSGSGTEFTLTISSLQPEDFA-<br>TYFCLQH<br>DSFPLTFGGGTKVEIK | SEQ ID NO: 629 |

In some embodiments, the DLL3 antigen binding domain comprises a scFv comprising a light chain variable (VL) region and the heavy chain variable (VH) region of a DLL3-specific monoclonal antibody joined by a flexible linker. Single chain variable region fragments may be made by linking light and/or heavy chain variable regions by using a linking peptide An example of a linking peptide is the GS linker having the amino acid sequence (GGGGS)$_x$ wherein x is 1, 2, 3, 4, or 5 (SEQ ID NO: 470). In some embodiments, x is 6, 7, 8, 9, 10, 11, 12, 13, 14, 15, or any integer less than about 20. In some embodiments, the linker is (GGGGS)$_4$ (SEQ ID NO: 478). In general, linkers can be short, flexible polypeptides, which in some embodiments are comprised of about 20 or fewer amino acid residues. Linkers can in turn be modified for additional functions, such as attachment of drugs or attachment to solid supports. The single chain variants can be produced either recombinantly or synthetically. For synthetic production of scFv, an automated synthesizer can be used. For recombinant production of scFv, a suitable plasmid containing polynucleotide that encodes the scFv can be introduced into a suitable host cell, either eukaryotic, such as yeast, plant, insect or mammalian cells, or prokaryotic, such as E. coli. Polynucleotides encoding the scFv of interest can be made by routine manipulations such as ligation of polynucleotides. The resultant scFv can be isolated using standard protein purification techniques known in the art.

In exemplary embodiments, provided herein are DLL3 antigen binding domains comprising: a VH region comprising a VH CDR1, VH CDR2, and VH CDR3 of the VH sequence shown in Table 1b and/or a VL region comprising VL CDR1, VL CDR2, and VL CDR3 of the VL sequence shown in Table 1c. In some embodiments, the VH and VL are linked together by a linker. In some embodiments the linker comprises the amino acid sequence GGGGSGGGGSGGGGSGGGGS (SEQ ID NO: 478). In some embodiments the linker may be encoded by a DNA sequence comprising GGCGGTGGAGGCTCCG-GAGGGGGGGGCTCTGGCGGAGGGGGCTCC (SEQ ID NO: 564). In some embodiments, the linker may be encoded by a DNA sequence comprising ggcggcggcggctctggaggag-gaggcagcggcggaggaggctccggaggcggcggctct (SEQ ID NO: 630). In some embodiments the linker comprises the amino acid sequence GGGGSGGGGSGGGGS (SEQ ID NO: 534). In some embodiments the linker is a scFv Whitlow linker, which may comprise the amino acid sequence GST-SGSGKPGSGEGSTKG (SEQ ID NO: 535). The scFv Whitlow linker may be encoded by a DNA sequence comprising GGGTCTACATCCGGCTCCGGGAAGCCCG-GAAGTGGCGAAGGTAGTACAAAGGGG (SEQ ID NO: 566). In some embodiments, the VH and VL sequences of the scFv's disclosed can be oriented with the VH sequence being located at the N-terminus of the scFv and followed by a linker and then the VL sequence, while in other embodiments the scFv can be oriented with the VL sequence at the N-Terminus and followed by a linker and then the VH sequence.

ii. Chimeric and Humanized Antibodies

In some embodiments, an anti-DLL-3 antibody agent is or comprises a monoclonal antibody, including a chimeric, humanized or human antibody.

In some embodiments, an anti-DLL-3 antibody agent provided herein can be a chimeric antibody (See, e.g., U.S. Pat. No. 4,816,567; and Morrison et al., Proc. Natl. Acad. Sci. USA, 81: 6851-6855 (1984)). A chimeric antibody can be an antibody in which a portion of the heavy and/or light chain is derived from a particular source or species, while the remainder of the heavy and/or light chain is derived from a different source or species. In one example, a chimeric antibody can comprise a non-human variable region (e.g., a variable region derived from a mouse, rat, hamster, rabbit, or non-human primate, such as a monkey) and a human constant region. In a further example, a chimeric antibody can be a "class switched" antibody in which the class or subclass has been changed from that of the parent antibody. Chimeric antibodies include antigen-binding fragments thereof.

In some embodiments, a chimeric antibody can be a humanized antibody (See, e.g., Almagro and Fransson, Front. Biosci., 13: 1619-1633 (2008); Riechmann et al., Nature, 332:323-329 (1988); Queen et al., Proc. Natl Acad. Sci. USA 86: 10029-10033 (1989); U.S. Pat. Nos. 5,821,337, 7,527,791, 6,982,321, and 7,087,409; Kashmiri et al., Methods 36:25-34 (2005); Padlan, Mol. Immunol, 28:489-498 (1991); Dall'Acqua et al., Methods, 36:43-60 (2005); Osbourn et al., Methods, 36:61-68 (2005); and Klimka et al., Br. J. Cancer, 83:252-260 (2000)). A humanized antibody is a chimeric antibody comprising amino acid residues from non-human hypervariable regions and amino acid residues from human FRs. In certain embodiments, a humanized antibody will comprise substantially all of at least one, and typically two, variable domains, in which all or substantially all of the hypervariable regions (e.g., CDRs) correspond to those of a non-human antibody, and all or substantially all of the FRs correspond to those of a human antibody. A humanized antibody optionally may comprise at least a portion of an antibody constant region derived from a human antibody.

A non-human antibody can be humanized to reduce immunogenicity to humans, while retaining the specificity and affinity of the parental non-human antibody. A humanized antibody can comprise one or more variable domains comprising one or more CDRs, or portions thereof, derived from a non-human antibody. A humanized antibody can comprise one or more variable domains comprising one or more FRs, or portions thereof, derived from human antibody sequences. A humanized antibody can optionally comprise at least a portion of a human constant region. In some embodiments, one or more FR residues in a humanized antibody are substituted with corresponding residues from a non-human antibody (e.g., the antibody from which the CDR residues are derived), to restore or improve antibody specificity or affinity.

Human framework regions that may be used for humanization include but are not limited to: framework regions selected using a "best-fit" method; framework regions derived from the consensus sequence of human antibodies of a particular subgroup of light or heavy chain variable regions; human mature (somatically mutated) framework regions or human germline framework regions; and framework regions derived from screening FR libraries (See, e.g., Sims et al., J. Immunol, 151:2296 (1993); Carter et al., Proc. Natl. Acad. Sci. USA, 89:4285 (1992); Presta et al., J. Immunol, 151:2623 (1993); Baca et al., J. Biol. Chem., 272: 10678-10684 (1997); and Rosok et al., J. Biol. Chem., 271:22611-22618 (1996)).

iii. Human Antibodies

In some embodiments, an anti-DLL-3 antibody agent provided herein is a human antibody. Human antibodies can be produced using various techniques known in the art (See, e.g., van Dijk and van de Winkel, Curr. Opin. Pharmacol, 5: 368-74 (2001); and Lonberg, Curr. Opin. Immunol, 20:450-459 (2008)). A human antibody can be one which possesses an amino acid sequence which corresponds to that of an antibody produced by a human or a human cell or derived from a non-human source that utilizes human antibody repertoires or other human antibody-encoding sequences. This definition of a human antibody specifically excludes a humanized antibody comprising non-human antigen-binding residues. Human antibodies may be prepared by administering an immunogen (e.g., a DLL-3 protein) to a transgenic animal that has been modified to produce intact human antibodies or intact antibodies with human variable regions in response to antigenic challenge (See, e.g., Lonberg, Nat. Biotech., 23: 1117-1125 (2005); U.S. Pat. Nos. 6,075,181, 6,150,584, 5,770,429, and 7,041,870; and U.S. Pat. App. Pub. No. US 2007/0061900) Human variable regions from intact antibodies generated by such animals may be further modified, e.g., by combining with a different human constant region.

Human antibodies can also be made by hybridoma-based methods. For example, human antibodies can be produced from human myeloma and mouse-human heteromyeloma cell lines, using human B-cell hybridoma technology, and other methods (See, e.g., Kozbor, J. Immunol, 133: 3001 (1984); Brodeur et al., Monoclonal Antibody Production Techniques and Applications, pp. 51-63 (1987); Boerner et al., J. Immunol, 147: 86 (1991); Li et al., Proc. Natl. Acad. Sci. USA, 103:3557-3562 (2006); U.S. Pat. No. 7,189,826; Ni, Xiandai Mianyixue, 26(4): 265-268 (2006); Vollmers and Brandlein, Histology and Histopathology, 20(3): 927-937 (2005); and Vollmers and Brandlein, Methods and Findings in Experimental and Clinical Pharmacology, 27(3): 185-91 (2005)). Human antibodies may also be generated by isolating Fv clone variable domain sequences selected from human-derived phage display libraries. Such variable domain sequences may then be combined with a desired human constant region.

Modifications of the oligosaccharide in an antibody can be made, for example, to create antibody variants with certain improved properties. For example, antibody glycosylation variants can have improved CDC function. In some embodiments, the present disclosure can contemplate an antibody variant that possesses some but not all effector functions, which make it a desirable candidate for applications in which the half-life of the antibody in vivo is important yet certain effector functions (such as complement) are unnecessary or deleterious. In vitro and/or in vivo cytotoxicity assays can be conducted to confirm the reduction/depletion of CDC activities.

iv. Antibody Derivatives

In some embodiments, an antibody agent provided herein may be further modified to contain additional nonproteinaceous moieties that are known in the art and readily available. The moieties suitable for derivatization of the antibody can include but are not limited to water soluble polymers. Non-limiting examples of water soluble polymers can include, but are not limited to, polyethylene glycol (PEG), copolymers of ethylene glycol/propylene glycol, carboxymethylcellulose, dextran, polyvinyl alcohol, polyvinyl pyrrolidone, poly-1,3-dioxolane, poly-1,3,6-trioxane, ethyl ene/maleic anhydride copolymer, polyaminoacids (either homopolymers or random copolymers), and dextran or poly(n-vinyl pyrrolidone)polyethylene glycol, polypropylene glycol homopolymers, polypropylene oxide/ethylene oxide co-polymers, polyoxyethylated polyols (e.g., glycerol), polyvinyl alcohol, and mixtures thereof. Polyethylene glycol propionaldehyde may have advantages in manufacturing due to its stability in water.

The polymer may be of any molecular weight, and may be branched or unbranched. The number of polymers attached to the antibody may vary, and if two or more polymers are attached, they can be the same or different molecules.

In some embodiments, conjugates of an antibody and nonproteinaceous moiety that may be selectively heated by exposure to radiation are provided. In some embodiments, the nonproteinaceous moiety can be a carbon nanotube (See, e.g., Kam et al., Proc. Natl. Acad. Sci. USA, 102: 11600-

11605 (2005)). The radiation may be of any wavelength, and can include, but is not limited to, wavelengths that do not harm ordinary cells, but which heat the nonproteinaceous moiety to a temperature at which cells proximal to the antibody-nonproteinaceous moiety are killed.

A DLL3 binding agent (e.g., a molecule comprising an antigen binding domain) is said to "specifically bind" its target antigen (e.g., human, cyno or mouse DLL3) when the dissociation constant (Kd) is ~1 nM. The antigen binding domain specifically binds antigen with "high affinity" when the Kd is 1-5 nM, and with "very high affinity" when the Kd is 0.1-0.5 nM. In one embodiment, the antigen binding domain has a Kd of ~1 nM. In one embodiment, the off-rate is <1×10⁻⁵. In other embodiments, the antigen binding domains will bind to human DLL3 with a Kd of between about $1\times10^{-7}$ M and $1\times10^{-12}$ M, and in yet another embodiment the antigen binding domains will bind with a Kd between about $1\times10^{-5}$ M and $1\times10^{-12}$ M.

As provided herein, the antigen binding domains of the present disclosure specifically bind mammalian DLL3 (e.g., human DLL3, cyno DLL3 or mouse DLL3). In certain embodiments, a DLL3 antigen binding domain of the present disclosure binds mammalian DLL3 with a Kd of less than $1\times10^{-6}$ M, less than $1\times10^{-7}$ M, less than $1\times10^{-8}$ M, or less than $1\times10^{-9}$ M. In one particular embodiment, the DLL3 antigen binding domains binds mammalian DLL3 (e.g., human DLL3, cyno DLL3 or mouse DLL3) with a Kd of less than $1\times10^{-7}$ M. In another embodiment, the DLL3 antigen binding domains binds mammalian DLL3 (e.g., human DLL3, cyno DLL3 or mouse DLL3) with a Kd of less than $1\times10^{-8}$ M. In some embodiments, the DLL3 antigen binding domains binds mammalian DLL3 (e.g., human DLL3, cyno DLL3) with a Kd of about $1\times10^{-7}$ M, about $2\times10^{-7}$ M, about $3\times10^{-7}$ M, about $4\times10^{-7}$ M, about $5\times10^{-7}$ M, about $6\times10^{-7}$ M, about $7\times10^{-7}$ M, about $8\times10^{-7}$ M, about $9\times10^{-7}$ M, about $1\times10^{-8}$ M, about $2\times10^{-8}$ M, about $3\times10^{-8}$ M, about $4\times10^{-8}$ M, about $5\times10^{-8}$ M, about $6\times10^{-8}$ M, about $7\times10^{-8}$ M, about $8\times10^{-8}$ M, about $9\times10^{-8}$ M, about $1\times10^{-9}$ M, about $2\times10^{-9}$ M, about $3\times10^{-9}$ M, about $4\times10^{-9}$ M, about $5\times10^{-9}$ M, about $6\times10^{-9}$ M, about $7\times10^{-9}$ M, about $8\times10^{-9}$ M, about $9\times10^{-9}$ M, about $1\times10^{-10}$ M, or about $5\times10^{-10}$ M. In certain embodiments, the Kd is calculated as the quotient of $K_{off}/K_{on}$, and the $K_{on}$ and $K_{off}$ are determined using a monovalent antibody, such as a Fab fragment, as measured by, e.g., BIAcore® surface plasmon resonance technology. In other embodiments, the Kd is calculated as the quotient of $K_{off}/K_{on}$, and the $K_{on}$ and $K_{off}$ are determined using a bivalent antibody, such as a Fab fragment, as measured by, e.g., BIAcore® surface plasmon resonance technology.

In some embodiments, the DLL3 antigen binding domain binds mammalian DLL3 (e.g., human DLL3, cyno DLL3 or mouse DLL3) with an association rate ($k_{on}$) of less than $1\times10^{-4}$ M⁴ s-¹, less than $2\times10^{-4}$ M⁴ less than $3\times10^{-4}$ M⁴ s-¹, less than $4\times10^{-4}$ M⁴ s-¹, less than $5\times10^{-4}$ M⁴ s-¹, less than $7\times10^{-4}$ M⁴ s-¹, less than $8\times10^{-4}$ M⁴ s-¹, less than $9\times10^{-4}$ M⁴ s-¹, less than $1\times10^{-5}$ M⁴ s-¹, less than $2\times10^{-5}$ M⁴ s-¹, less than $3\times10^{-5}$ M⁴ s-¹, less than $4\times10^{-5}$ M⁴ s-¹, less than $5\times10^{-5}$ M⁴ s-¹, less than $6\times10^{-5}$ M⁴ s-¹, less than $7\times10^{-5}$ M⁴ s-¹, less than $8\times10^{-5}$ M⁴ s-¹, less than $9\times10^{-5}$ M⁴ s-¹, less than $1\times10^{-6}$ M⁴ s-¹, less than $2\times10^{-6}$ M⁴ s-¹, less than $3\times10^{-6}$ M⁴ s-¹, less than $4\times10^{-6}$ M⁴ s-¹, less than $5\times10^{-6}$ M⁴ s-¹, less than $6\times10^{-6}$ M⁴ s-¹, less than $7\times10^{-6}$ M⁴ s-¹, less than $8\times10^{-6}$ M⁴ s-¹, less than $9\times10^{-6}$ M⁴ s-¹, or less than $1\times10^{-7}$ M⁴ s-¹. In certain embodiments, the $k_{on}$ is determined using a monovalent antibody, such as a Fab fragment, as measured by, e.g., BIAcore® surface plasmon resonance technology. In other embodiments, the $k_{on}$ is determined using a bivalent antibody as measured by, e.g., BIAcore® surface plasmon resonance technology.

In some embodiments, the DLL3 antigen binding domain binds mammalian DLL3 (e.g., human DLL3, cyno DLL3 or mouse DLL3) with an dissociation rate ($k_{off}$) of less than $1\times10^{-2}$ s⁻¹, less than $2\times10^{-2}$ s⁻¹, less than $3\times10^{-2}$ s⁻¹, less than $4\times10^{-2}$ s⁻¹, less than $5\times10^{-2}$ s⁻¹, less than $6\times10^{-2}$ s⁻¹, less than $7\times10^{-2}$ s⁻¹, less than $8\times10^{-2}$ s⁻¹, less than $9\times10^{-2}$ s⁻¹, less than $1\times10^{-3}$ s⁻¹, less than $2\times10^{-3}$ s⁻¹, less than $3\times10^{-3}$ s⁻¹, less than $4\times10^{-3}$ s⁻¹, less than $5\times10^{-3}$ s⁻¹, less than $6\times10^{-3}$ s⁻¹, less than $7\times10^{-3}$ s⁻¹, less than $8\times10^{-3}$ s⁻¹, less than $9\times10^{-3}$ s⁻¹, less than $1\times10^{-4}$ s⁻¹, less than $2\times10^{-4}$ s⁻¹, less than $3\times10^{-4}$ s⁻¹, less than $4\times10^{-4}$ s⁻¹, less than $5\times10^{-4}$ s⁻¹, less than $6\times10^{-4}$ s⁻¹ less than $7\times10^{-4}$ s⁻¹, less than $8\times10^{-4}$ s⁻¹, less than $9\times10^{-4}$ s⁻¹, less than $1\times10^{-5}$ s⁻¹, or less than $5\times10^{-4}$ s⁻¹. In certain embodiments, the $k_{off}$ is determined using a monovalent antibody, such as a Fab fragment, as measured by, e.g., BIAcore® surface plasmon resonance technology. In other embodiments, the $k_{off}$ is determined using a bivalent antibody as measured by, e.g., BIAcore® surface plasmon resonance technology.

II. Chimeric Antigen Receptors

As used herein, chimeric antigen receptors (CARs) are proteins that specifically recognize target antigens (e.g., target antigens on cancer cells). When bound to the target antigen, the CAR may activate the immune cell to attack and destroy the cell bearing that antigen (e.g., the cancer cell). CARs may also incorporate costimulatory or signaling domains to increase their potency. See Krause et al., J. Exp. Med., Volume 188, No. 4, 1998 (619-626); Finney et al., *Journal of Immunology*, 1998, 161: 2791-2797, Song et al., Blood 119:696-706 (2012); Kalos et al., *Sci. Transl. Med.* 3:95 (2011); Porter et al., *N Engl. J. Med.* 365:725-33 (2011), and Gross et al., *Annu. Rev. Pharmacol. Toxicol.* 56:59-83 (2016); U.S. Pat. Nos. 7,741,465, and 6,319,494.

Chimeric antigen receptors described herein comprise an extracellular domain, a transmembrane domain, and an intracellular domain, wherein the extracellular domain comprises a DLL3 antigen binding domain that specifically binds to DLL3. In some embodiments, the DLL-3 specific CAR comprises the following elements from 5' to 3': a signal sequence, a DLL3 antigen binding domain (e g, an anti-DLL3 scFv), a hinge and transmembrane region, and one or more successive signaling domains. In certain embodiments, the DLL-3 specific CAR comprises the following elements from 5' to 3': a CD8α signal sequence, a DLL3 scFv comprising a DLL3 variable heavy chain and/or variable light chain described herein, a CD8α hinge and transmembrane region, a 41BB cytoplasmic signaling domain, and a CD3ζ cytoplasmic signaling domain. (FIG. 4, Table 7).

In some embodiments, the DLL-3 specific CARs further comprise a safety switches and/or monoclonal antibody specific-epitope.

a. Antigen Binding Domain

As discussed above, the DLL3 CARs described herein comprise an antigen binding domain. An "antigen binding domain" as used herein means any polypeptide that binds a specified target antigen, for example the specified target antigen can be the DLL3 (DLL-3) protein or fragment thereof (referred to interchangeably herein as a "DLL3 antigen", "DLL3 target antigen", or "DLL3 target"). In some embodiments, the antigen binding domain binds to a DLL3 antigen on a tumor cell. In some embodiments, the antigen binding domain binds to a DLL3 antigen on a cell involved in a hyperproliferative disease.

In some embodiments, the antigen binding domain comprises a variable heavy chain, variable light chain, and/or one or more CDRs described herein. In some embodiments, the antigen binding domain is a single chain variable fragment (scFv), comprising light chain CDRs CDR1, CDR2 and CDR3, and heavy chain CDRs CDR1, CDR2 and CDR3.

In some embodiments, DLL-3 specific CARs comprise a VH shown in Table 1b. In some embodiments, DLL-3 specific CARs comprise a VL shown in Table 1c. In some embodiments, DLL-3 specific CARs comprise a heavy chain CDR1, CDR2, CDR3 shown in Table 1e. In some embodiments, DLL-3 specific CARs comprise a light chain CDR1, CDR2, CDR3 shown in Table 1f.

Variants of the antigen binding domains (e.g., variants of the CDRs, VH and/or VL) are also within the scope of the disclosure, e.g., variable light and/or variable heavy chains that each have at least 70-80%, 80-85%, 85-90%, 90-95%, 95-97%, 97-99%, or above 99% identity to the amino acid sequences of the antigen binding domain sequences described herein. In some instances, such molecules include at least one heavy chain and one light chain, whereas in other instances the variant forms contain two variable light chains and two variable heavy chains (or subparts thereof). A skilled artisan will be able to determine suitable variants of the antigen binding domains as set forth herein using well-known techniques. In certain embodiments, one skilled in the art can identify suitable areas of the molecule that may be changed without destroying activity by targeting regions not believed to be important for activity.

In certain embodiments, the polypeptide structure of the antigen binding domains is based on antibodies, including, but not limited to, monoclonal antibodies, bispecific antibodies, minibodies, domain antibodies, synthetic antibodies (sometimes referred to herein as "antibody mimetics"), chimeric antibodies, humanized antibodies, human antibodies, antibody fusions (sometimes referred to herein as "antibody conjugates"), and fragments thereof, respectively. In some embodiments, the antigen binding domain comprises or consists of avimers.

A DLL3 antigen binding domain is said to be "selective" when it binds to one target more tightly than it binds to a second target.

In some embodiments, the DLL3 antigen binding domain is a scFv. In some embodiments, the DLL3 specific CAR comprises an scFv provided in Table 1d.

In some embodiments, the DLL3 specific CAR comprises a leader or signal peptide; in some embodiments the leader peptide comprises an amino acid sequence that is at least about 75%, at least about 80%, at least about 85%, at least about 90%, at least about 95%, at least about 96%, at least about 97%, at least about 98%, at least about 99%, or 100% identical to the amino acid sequence MALPVTALLL-PLALLLHAARP (SEQ ID NO: 477). In some embodiments, the leader peptide comprises the amino acid sequence of SEQ ID NO: 477. In some embodiments, the leader peptide is encoded by a nucleic acid sequence comprising:

(SEQ ID NO: 555)
ATGGCACTCCCCGTAACTGCTCTGCTGCTGCCGTTGGCATTGCTCCTGC

ACGCCGCACGCCCG

In other embodiments, the disclosure relates to isolated polynucleotides encoding any one of the DLL3 antigen binding domains described herein. In some embodiments, the disclosure relates to isolated polynucleotides encoding a DLL3 CAR described in Table 10. Also provided herein are vectors comprising the polynucleotides, and methods of making the same.

TABLE 10

Polynucleotide Sequences of exemplary DLL3 targeting CARs

| SEQ ID NO | CAR Structure | Nucleotide Sequence |
| --- | --- | --- |
| 570 | CD8α signal sequence, 2D3 scFv, CD8α hinge and transmembrane regions, 41BB cytoplasmic signaling domain, CD3ζ cytoplasmic signaling domain | ATGGCTCTGCCCGTCACCGCTCTGCTGCTGCCTCTGGCTC TGCTGCTGCACGCCGCACGACCACAGGTCCAGGTGCAGC TGCAGGAGAGCGGCCCAGGCCTGGTGAAGCCATCTGAG ACACTGAGCCTGACCTGCACAGTGAGCGATAACTCCATC TCTAATTACTATTGGTCCTGGATCAGGCAGCCCCCTGGC AAGGGCCTGGAGTGGATCGCCTACATCTACTATTCTGGC ACCACAAACTATAATCCCAGCCTGAAGTCCAGAGTGACC ATCTCCCTGGACACATCTAAGAACCAGTTCTCCCTGAAG CTGAGCTCCGTGACCGCAGCAGATACAGCCGTGTACTAT TGTGCCCGGCTGTTTAATTGGGGCTTCGCCTTTGACATCT GGGGCCAGGGCACCATGGTGACAGTGTCTAGCGGAGGA GGAGGAAGCGGAGGAGGAGGGTCCGGAGGCGGGGGAT CTGAGATCGTGATGACCCAGTCTCCAGCCACACTGTCCG TGTCTCCCGGCGAGAGGGCCACCCTGAGCTGCAGAGCC AGCCAGTCCGTGAGCTCCAACCTGGCCTGGTACCAGCAG AAGCCTGGCCAGGCACCTCGGCTGCTGATCTATGGAGCA TCCACCAGGGCCACAGGAATCCCTGCACGCTTCTCTGGA AGCGGATCCGGCACAGAGTTTACCCTGACAATCTCTAGC CTGCAGTCTGAGGACTTCGCCGTGTACTATTGTCAGCAG TACAACAATTGGCCCCTGACCTTTGGCGGCGGCACAAAG GTGGAGATCAAGACCACAACTCCTGCACCTAGGCCACCT ACCCCAGCACCTACAATTGCTAGTCAGCCACTGTCACTG CGACCAGAGGCATGTCGACCTGCAGCTGGAGGAGCAGT GCATACAAGGGGACTGGACTTTGCCTGCGATATCTACAT TTGGGCTCCTCTGGCAGGAACATGTGGCGTGCTGCTGCT GAGCCTGGTCATCACTCTGTACTGCAAGCGAGGCCGGAA GAAACTGCTGTATATTTTCAAACAGCCCTTTATGCGACC TGTGCAGACCACACAGGAGGAAGATGGGTGCTCCTGTC GGTTCCCCGAGGAAGAGGAAGGAGGCTGTGAGCTGCGG GTCAAGTTTTCCAGATCTGCAGACGCCCCTGCTTACCAG CAGGGCCAGAACCAGCTGTATAACGAGCTGAATCTGGG |

TABLE 10-continued

Polynucleotide Sequences of exemplary DLL3 targeting CARs

| SEQ ID NO | CAR Structure | Nucleotide Sequence |
|---|---|---|
| | | GCGGAGAGAGGAATACGACGTGCTGGATAAAAGGCGCG<br>GGAGAGACCCAGAAATGGGGGAAAGCCACGACGGAA<br>AAACCCCCAGGAGGGACTGTACAATGAACTGCAGAAGG<br>ATAAAATGGCAGAGGCCTATTCCGAAATCGGGATGAAG<br>GGAGAAAGAAGGCGAGGCAAAGGACACGACGGACTGT<br>ACCAGGGGCTGTCTACCGCCACAAAGGACACCTATGAT<br>GCTCTGCATATGCAGGCACTGCCACCCAGG |
| 571 | CD8α signal sequence, 5A2 scFv, CD8α hinge and transmembrane regions, 41BB cytoplasmic signaling domain, CD3ζ cytoplasmic signaling domain | ATGGCTCTGCCCGTCACCGCTCTGCTGCTGCCTCTGGCTC<br>TGCTGCTGCACGCCGCACGACCACAGGTGCAGCTGCAG<br>GAGTCTGGCCCAGGCCTGATGAAGCCCAGCGAGACACT<br>GTCCCTGACCTGCACAGTGTCTGGCGGCAGCATCAGCTC<br>CTCTTACTGGAGCTGTATCAGGCAGCCCCCTGGCAAGGG<br>CCTGGAGTGGATCGGCTACATCTACTATTCCGGCACCAC<br>AAACTATAATCCTTCCCTGAAGTCTCGGGTGACCCTGTC<br>TCTGGACACAAGCAAGAACCAGTTCTCCCTGAGACTGAC<br>CTCTGTGACAGCCGCCGATACCGCCGTGTACTATTGCGC<br>CAGAGTGGCCCCCACAGGCTTCTGGTTTGACTATTGGGG<br>CCAGGGCACCCTGGTGACAGTGAGCTCCGGAGGAGGAG<br>GAAGCGGAGGAGGAGGGTCCGGAGGCGGGGGATCTGA<br>GATCGTGCTGACCCAGTCCCCAGGCACACTGTCCCTGTC<br>TCCCGGCGAGAGAGCCACCCTGAGCTGCAGGGCCTCCC<br>AGAGAGTGAGCTCCAGGTACCTGGCCTGGTATCAGCAG<br>AAGCCTGGCCAGGCCCCCAGACTGCTGATCTACGGAGC<br>ATCTAGCCGCGCCACCGGAATCCCAGACCGGTTCAGCGG<br>ATCCGGATCTGGCACAGACTTCACCCTGACAATCTCTAG<br>ACTGGAGCCTGAGGAGTTCGCCGTGTACTATTGTCAGCA<br>GTATGGCACCAGCCCACTGACATTTGGCGGCGGCACAA<br>AGGTGGAGATCAAGACCACAACTCCTGCACCTAGGCCA<br>CCTACCCCAGCACCTACAATTGCTAGTCAGCCACTGTCA<br>CTGCGACCAGAGGCATGTCGACCTGCAGCTGGAGGAGC<br>AGTGCATACAAGGGGACTGGACTTTGCCTGCGATATCTA<br>CATTTGGGCTCCTCTGGCAGGAACATGTGGCGTGCTGCT<br>GCTGAGCCTGGTCATCACTCTGTACTGCAAGCGAGGCCG<br>GAAGAAACTGCTGTATATTTTCAAACAGCCCTTTATGCG<br>ACCTGTGCAGACCACACAGGAGGAAGATGGGTGCTCCT<br>GTCGGTTCCCCGAGGAAGAGGAAGGAGGCTGTGAGCTG<br>CGGGTCAAGTTTTCCAGATCTGCAGACGCCCCTGCTTAC<br>CAGCAGGGCCAGAACCAGCTGTATAACGAGCTGAATCT<br>GGGGCGGAGAGAGGAATACGACGTGCTGGATAAAAGGC<br>GCGGGAGAGACCCAGAAATGGGGGAAAGCCACGACG<br>GAAAAACCCCCAGGAGGGACTGTACAATGAACTGCAGA<br>AGGATAAAATGGCAGAGGCCTATTCCGAAATCGGGATG<br>AAGGGAGAAAGAAGGCGAGGCAAAGGACACGACGGAC<br>TGTACCAGGGGCTGTCTACCGCCACAAAGGACACCTATG<br>ATGCTCTGCATATGCAGGCACTGCCACCCAGG |
| 572 | CD8α signal sequence, 7F9 scFv, CD8α hinge and transmembrane regions, 41BB cytoplasmic signaling domain, CD3ζ cytoplasmic signaling domain | ATGGCTCTGCCCGTCACCGCTCTGCTGCTGCCTCTGGCTC<br>TGCTGCTGCACGCCGCACGACCACAGGTCCAGCTGGTCC<br>AGTCAGGGGCCGAGGTGAAGAAACCTGGGGCTTCTGTG<br>AAGGTCAGTTGCAAAGCTAGTGGATACTCATTCCCTGAT<br>TACTATATCAACTGGGTGCGCCAGGCACCAGGACAGGG<br>ACTGGAGTGGATGGGATGGATCTACTTCGCTAGCGGCAA<br>CTCCGAATATAATCAGAAGTTTACAGGCAGAGTGACTAT<br>GACCAGGGACACAAGCTCCTCTACTGCCTATATGGAGCT<br>GAGTTCACTGCGGAGTGAAGATACCGCAGTGTACTTCTG<br>CGCCTCTCTGTACGACTATGATTGGTATTTTGACGTCTGG<br>GGACAGGGCACTATGGTGACCGTCAGCTCCGGAGGAGG<br>AGGAAGCGGAGGAGGAGGGTCCGGAGGCGGGGATCT<br>GATATCGTGATGACACAGACTCCCCTGTCACTGAGCGTC<br>ACTCCAGGAGAGCCAGCATCCATTTCTTGTAAGTCTAGT<br>CAGTCACTGGTGCACAGCAACGGAAATACCTACCTGCAT<br>TGGTATCTGCAGAAGCCTGGCCAGAGCCCACAGCTGCTG<br>ATCTACAAAGTGTCCAATAGGTTCTCTGGCGTCCCAGAC<br>CGCTTTAGTGGGTCAGGAAGCGGCGCCGATTTCACCCTG<br>AAAATTAGCCGCGTGGAGGCTGAAGACGTGGGCGTCTA<br>CTATTGCGCAGAGACAAGCCACGTCCCCTGGACTTTTGG<br>GCAGGGAACCAAGCTGGAAATCAAAACCACAACTCCTG<br>CACCTAGGCCACCTACCCCAGCACCTACAATTGCTAGTC<br>AGCCACTGTCACTGCGACCAGAGGCATGTCGACCTGCAG<br>CTGGAGGAGCAGTGCATACAAGGGGACTGGACTTTGCC<br>TGCGATATCTACATTTGGGCTCCTCTGGCAGGAACATGT<br>GGCGTGCTGCTGCTGAGCCTGGTCATCACTCTGTACTGC<br>AAGCGAGGCCGGAAGAAACTGCTGTATATTTTCAAACA |

TABLE 10-continued

Polynucleotide Sequences of exemplary DLL3 targeting CARs

| SEQ ID NO | CAR Structure | Nucleotide Sequence |
|---|---|---|
| | | GCCCTTTATGCGACCTGTGCAGACCACACAGGAGGAAG<br>ATGGGTGCTCCTGTCGGTTCCCCGAGGAAGAGGAAGGA<br>GGCTGTGAGCTGCGGGTCAAGTTTTCCAGATCTGCAGAC<br>GCCCCTGCTTACCAGCAGGGCCAGAACCAGCTGTATAAC<br>GAGCTGAATCTGGGGCGGAGAGAGGAATACGACGTGCT<br>GGATAAAAGGCGCGGGAGAGACCCCAGAAATGGGGGGA<br>AAGCCACGACGGAAAAACCCCCAGGAGGGACTGTACAA<br>TGAACTGCAGAAGGATAAAATGGCAGAGGCCTATTCCG<br>AAATCGGGATGAAGGGAGAAAGAAGGCGAGGCAAAGG<br>ACACGACGGACTGTACCAGGGGCTGTCTACCGCCACAA<br>AGGACACCTATGATGCTCTGCATATGCAGGCACTGCCAC<br>CCAGG |
| 631 | CD8α signal sequence, 7F9 scFv, CD8α hinge and transmembrane regions, 41BB cytoplasmic signaling domain, CD3ζ cytoplasmic signaling domain | atggctctgcccgtcaccgctctgctgctgcctctggctctgctgctgcacgccgcacgacca<br>gaggtgcagctggtggagagcggaggaggcctggtgcagcctggcggcagcctgaggct<br>gtcctgcgcagcatctggcttcacctttagctcccacgacatgcactgggtgaggcaggcaac<br>aggcaagggcctggagtgggtgtccgccatcggaatcgcaggcgataccttactattccggct<br>ctgtgaagggccggttcacaatcagcagagagaacgccaagaattccctgtacctgcagatg<br>aactctctgagggccggcgacaccgccgtgtactattgtgccagagccaattggggcgagg<br>gcgcctttgatatctggggccagggcaccatggtgacagtgtctagcggcggcggcggctct<br>ggaggaggaggcagcggcggaggaggctccggaggcggcggctctgacatccagatga<br>cacagtctcctagctccctgtccgcctctgtgggcgaccgggtgaccatcacatgcagagcc<br>agccagggcatctccgattacctggcctggtatcagcagaagcccggcaagatccctaagct<br>gctgatctacgcagcatctaccctgcagagcggagtgccatcccggttcagcggatccggat<br>ctggaacagactttaccctgacaatctctagcctgcagccagaggatgtggccacctact-<br>attg<br>tcagaagtataactccgtgccactgaccttcggcggaggaacaaaggtggagatcaagacca<br>caactcctgcacctaggccacctaccccagcacctacaattgctagtcagccactgtcactgc<br>gaccagaggcatgtcgacctgcagctggaggagcagtgcatacaaggggactggactagc<br>ctgcgatatctacatagggctcctctggcaggaacatgtggcgtgctgctgctgagcctggtc<br>atcactctgtactgcaagcgaggccggaagaaactgctgtatattacaaacagcccctttatgc<br>gacctgtcagaccacacaggaggaagatgggtgctcctgtcggttccccgaggaagagg<br>aaggaggctgtgagctgcgggtcaagttaccagatctgcagacgcccctgcttaccagcag<br>ggccagaaccagctgtataacgagctgaatctggggcggagagaggaatacgacgtgctg<br>gataaaaggcgcgggagagacccccagaaatggggggaaagccacgacggaaaaacccc<br>aggagggactgtacaatgaactgcagaaggataaaatggcagaggcctattccgaaatcgg<br>gatgaagggagaaagaaggcgaggcaaaggacacgacggactgtaccaggggctgtcta<br>ccgccacaaaggacacctatgatgctctgcatatgcaggcactgccacccagg |
| 573 | CD8α signal sequence, 9D3 scFv, CD8α hinge and transmembrane regions, 41BB cytoplasmic signaling domain, CD3ζ cytoplasmic signaling domain | ATGGCTCTGCCTGTCACCGCTCTGCTGCTGCCTCTGGCTC<br>TGCTGCTGCACGCGGCGCGCCCGCAGGTGCAGCTGCAG<br>GAGTCTGGCCCAGGCCTGGTGAAGCCCTCTGAGACACTG<br>AGCCTGACCTGCACAGTGAGCGACGATTCCATCTCTAAC<br>TACTATTGGTCCTGGATCAGGCAGCCCCCTGGCAAGGGC<br>CTGGAGTGGATCGGCTACATCTTCTATTCCGGCACCACA<br>AACCACAATCCCAGCCTGAAGTCCCGGCTGACAATCTCC<br>CTGGACAAGGCCAAGAACCAGTTCTCTCTGAGACTGAGC<br>TCCGTGACCGCCGCCGATACAGCCGTGTACTATTGTGCC<br>AGAGTGTTCAACTGGGGCTTCGCCTTTGACATCTGGGGC<br>CAGGGCACCATGGTGACAGTGTCTAGCGGCGGCGGCGG<br>CTCTGGAGGAGGAGGCAGCGGCGGAGGAGGCTCCGGAG<br>GCGGCGGCTCTGAGATCGTGCTGACCCAGTCTCCAGGCA<br>CACTGTCTCTGAGCCCCGGCGAGAGGGCCACCCTGAGCT<br>GCCGCGCCTCCCAGCGGATCTCTAGAACATACCTGGCCT<br>GGTATCAGCAGAAGCCTGGCCAGGCCCCCAGACTGCTG<br>ATCTACGGAGCAAGCAGCCGGGCCACCGGAATCCCCGA<br>CAGATTCACCGGCTCCGGCTCTGGCACAGACTTCACCCT<br>GACAATCAGCAGACTGGAGCCTGAGGACTTCGCCGTGT<br>ACTATTGTCAGCAGTATGGCACCTCCCCACTGACATTTG<br>GCGGCGGCACAAAGGTGGAGATCAACACCACAACCCCA<br>GCACCTAGGCCACCTACACCTGCACCAACCATCGCCAGC<br>CAGCCTCTGTCCCTGAGACCAGAGGCCTGTAGGCCAGCA<br>GCAGGAGGAGCAGTGCACACCCGGGGCCTGGACTTCGC<br>CTGCGATATCTACATCTGGGCACCACTGGCAGGAACATG<br>TGGCGTGCTGCTGCTGTCCCTGGTCATCACCCTGTACTGC<br>AAGAGAGGCAGGAAGAAGCTGCTGTATATCTTCAAGCA<br>GCCCTTCATGAGACCCGTGCAGACAACCCAGGAGGAGG<br>ACGGCTGCAGCTGTAGGTTCCCAGAGGAGGAGGAGGGA<br>GGATGTGAGCTGCGCGTGAAGTTTTCCCGGTCTGCCGAT<br>GCACCTGCATACCAGCAGGGACAGAACCAGCTGTATAA<br>CGAGCTGAATCTGGGCCGGAGAGAGGAGTACGACGTGC<br>TGGATAAGAGGAGGGGAAGGGACCCTGAGATGGGAGGC<br>AAGCCTCGGAGAAAGAACCCACAGGAGGGCCTGTACAA<br>TGAGCTGCAGAAGGACAAGATGGCCGAGGCCTATAGCG |

TABLE 10-continued

Polynucleotide Sequences of exemplary DLL3 targeting CARs

| SEQ ID NO | CAR Structure | Nucleotide Sequence |
|---|---|---|
| | | AGATCGGCATGAAGGGAGAGAGGCGCCGGGGCAAGGG<br>ACACGATGGCCTGTATCAGGGCCTGTCAACCGCTACAAA<br>AGATACCTACGATGCTCTGCACATGCAGGCTCTGCCACC<br>AAGA |
| 574 | CD8α signal sequence, 26C8 scFv, CD8α hinge and transmembrane regions, 41BB cytoplasmic signaling domain, CD3ζ cytoplasmic signaling domain | ATGGCTCTGCCTGTCACCGCTCTGCTGCTGCCTCTGGCTC<br>TGCTGCTGCACGCGGCGCGCCCGCAGGTGCAGCTGCAG<br>GAGAGCGGCCCAGGCCTGGTGAAGCCATCTGAGACACT<br>GAGCCTGACCTGCACAGTGAGCGATAACTCCATCTCTAA<br>TTACTATTGGTCCTGGATCAGGCAGCCCCCTGGCAAGGG<br>CCTGGAGTGGATCGCCTACATCTACTATTCTGGCACCAC<br>AAACTATAATCCCAGCCTGAAGTCCAGAGTGACCATCTC<br>CCTGGACACATCTAAGAACCAGTTCTCCCTGCAGCTGAG<br>CTCCGTGACAGCAGCAGATGCAGCCGTGTACTATTGTGC<br>CAGAGTGTTCCACTGGGGCTTCGCCTTTGACATCTGGGG<br>CCAGGGCACCATGGTGACAGTGTCTAGCGGCGGCGGCG<br>GCTCTGGAGGAGGAGCAGCGGCGGAGGAGGCTCCGGA<br>GGCGGCGGCTCTGAGATCGTGCTGACCCAGAGCCCAGG<br>CACACTGTCTCTGAGCCCCGGCGAGAGGGCCACCCTGTC<br>CTGCCGGGCCTCTCAGAGAGTGAGCAACACATACCTGGC<br>CTGGTATCAGCAGAATCCCGGCCAGGCCCCCAGACTGCT<br>GATCTACGGAGCAAGCTCCAGGGCCACCGGAATCCCAG<br>ACCGCTTCTCCGGATCTGGAAGCGGCACAGACTTCACCC<br>TGACAATCTCCCGGCTGGAGCCTGAGGACTTCGCCGTGT<br>ACTATTGTCAGCAGTATGGCACCTCTCCACTGACATTTG<br>GCGGCGGCACCAAGGTGGAGATCAAGACCACAACCCCA<br>GCACCTAGGCCACCTACACCTGCACCAACCATCGCCAGC<br>CAGCCTCTGTCCCTGAGACCAGAGGCCTGTAGGCCAGCA<br>GCAGGAGGAGCAGTGCACACCCGGGGCCTGGACTTCGC<br>CTGCGATATCTACATCTGGGCACCACTGGCAGGAACATG<br>TGGCGTGCTGCTGCTGTCCCTGGTCATCACCCTGTACTGC<br>AAGAGAGGCAGGAAGAAGCTGCTGTATATCTTCAAGCA<br>GCCCTTCATGAGACCCGTGCAGACAACCCAGGAGGAGG<br>ACGGCTGCAGCTGTAGGTTCCCAGAGGAGGAGGAGGGA<br>GGATGTGAGCTGCGCGTGAAGTTTTCCCGGTCTGCCGAT<br>GCACCTGCATACCAGCAGGGACAGAACCAGCTGTATAA<br>CGAGCTGAATCTGGGCCGGAGAGAGGAGTACGACGTGC<br>TGGATAAGAGGAGGGGAAGGGACCCTGAGATGGGAGGC<br>AAGCCTCGGAGAAAGAACCCACAGGAGGGCCTGTACAA<br>TGAGCTGCAGAAGGACAAGATGGCCGAGGCCTATAGCG<br>AGATCGGCATGAAGGGAGAGAGGCGCCGGGGCAAGGG<br>ACACGATGGCCTGTATCAGGGCCTGTCAACCGCTACAAA<br>AGATACCTACGATGCTCTGCACATGCAGGCTCTGCCACC<br>AAGA |
| 575 | CD8α signal sequence, 2A6.C5 scFv, CD8α hinge and transmembrane regions, 41BB cytoplasmic signaling domain, CD3ζ cytoplasmic signaling domain | ATGGCTCTGCCCGTCACCGCTCTGCTGCTGCCTCTGGCTC<br>TGCTGCTGCACGCCGCACGACCACAGGTGCAGCTGCAG<br>GAGAGCGGCCCAGGCCTGGTGAAGCCATCCGAGACCCT<br>GTCTCTGACCTGCACAGTGAGCAACGTGTCCATCAGCTC<br>CTACTATTGGTCTTGGATCAGGCAGCCCCCTGGCAAGGG<br>ACTGGAGTGGATCGGCTACATCTACTATAGCGGCACCAC<br>AAACTATAATCCCTCTCTGAAGAGCAGAGTGACCATGAG<br>CGTGGACACATCCAAGAACCAGTTCTCCCTGAAGCTGTC<br>TAGCGTGACCGCCGCCGATACAGCCGTGTACTTTTGTGC<br>CCGGCTGTCTAATTGGGGCTTCGCCTTTGACATCTGGGG<br>CCAGGGCACCATGGTGACATTCTCCTCTGGAGGAGGAG<br>GAAGCGGAGGAGGAGGGTCCGGAGGCGGGGATCTGA<br>GATCGTGCTGACCCAGTCTCCAGGCACACTGTCTCTGAG<br>CCCCGGCGAGAGGGCCACCCTGTCCTGCAGAGCCTCTCA<br>GACAATCAGCTCCTCTTACCTGGCCTGGTATCAGCAGAA<br>GCCTGGCCAGGCACCTCGGCTGCTGATCTACGAGCAAG<br>CTCCAGGGCCACCGGAATCCCAGACCGCTTCTCCGGATC<br>TGGAAGCGGCACAGAGTTTACCCTGACAATCAGCCGGCT<br>GGAGCCTGAGGATTTCGCCGTGTACTATTGTCAGCAGTA<br>TGGCTGGTCCCCAATCACCTTTGGCCAGGGCACAAGGCT<br>GGAGATCAAGACCACAACTCCTGCACCTAGGCCACCTAC<br>CCCAGCACCTACAATTGCTAGTCAGCCACTGTCACTGCG<br>ACCAGAGGCATGTCGACCTGCAGCTGGAGGAGCAGTGC<br>ATACAAGGGGACTGGACTTTGCCTGCGATATCTACATTT<br>GGGCTCCTCTGGCAGGAACATGTGGCGTGCTGCTGCTGA<br>GCCTGGTCATCACTCTGTACTGCAAGCGAGGCCGGAAGA<br>AACTGCTGTATATTTTCAAACAGCCCTTTATGCGACCTGT<br>GCAGACCACACAGGAGGAAGATGGGTGCTCCTGTCGGT<br>TCCCCGAGGAAGAGGAAGGAGGCTGTGAGCTGCGGGTC |

TABLE 10-continued

Polynucleotide Sequences of exemplary DLL3 targeting CARs

| SEQ ID NO | CAR Structure | Nucleotide Sequence |
|---|---|---|
| | | AAGTTTTCCAGATCTGCAGACGCCCCTGCTTACCAGCAG<br>GGCCAGAACCAGCTGTATAACGAGCTGAATCTGGGGCG<br>GAGAGAGGAATACGACGTGCTGGATAAAAGGCGCGGGA<br>GAGACCCAGAAATGGGGGGAAAGCCACGACGGAAAAA<br>CCCCCAGGAGGGACTGTACAATGAACTGCAGAAGGATA<br>AAATGGCAGAGGCCTATTCCGAAATCGGGATGAAGGGA<br>GAAAGAAGGCGAGGCAAAGGACACGACGGACTGTACCA<br>GGGGCTGTCTACCGCCACAAAGGACACCTATGATGCTCT<br>GCATATGCAGGCACTGCCACCCAGG |
| 576 | CD8α signal sequence, 5E12 scFv, CD8α hinge and transmembrane regions, 41BB cytoplasmic signaling domain, CD3ζ cytoplasmic signaling domain | ATGGCTCTGCCCGTCACCGCTCTGCTGCTGCCTCTGGCTC<br>TGCTGCTGCACGCCGCACGACCAGAGGTGCAGCTGGTG<br>GAGAGCGGAGGAGGACTGGTGCAGCCTGGCGGATCCCT<br>GAGGCTGTCTTGCGCAGCAAGCGGCTTCACCTTTAGCTC<br>CTACGACATGCACTGGGTGAGGCAGGCAACAGGCAAGG<br>GACTGGAGTGGGTGTCCGCCATCGGACCAGCCGGCGAT<br>ACCTACTATCCCGGCTCTGTGAAGGGCCGGTTCACAATC<br>TCCAGAGAGAACGCCAAGAATTCTCTGTATCTGCAGATG<br>AACAGCCTGAGGGCAGGCGACACCGCCGTGTACTATTGT<br>GCCAGAGCCGACCCCCCTTACTATTACTATGGCATGGAC<br>GTGTGGGGCCAGGGCACCACAGTGACAGTGTCTAGCGG<br>AGGAGGAGGAAGCGGAGGAGGAGGGTCCGGAGGCGGG<br>GGATCTGACATCGTGATGACCCAGTCCCCTCTGTCTCTG<br>CCCGTGACACCTGGCGAGCCAGCCTCTATCAGCTGCAGG<br>AGCTCCCAGAGCCTGCTGCACTCCAACGAGTACAATTAT<br>CTGGATTGGTACCTGCAGAAGCCTGGCCAGTCCCCTCAG<br>CTGCTGATCTATCTGGGCTCTAACAGGGCAAGCGGAGTG<br>CCAGACAGATTCTCCGGCTCTGGCAGCGGCACCGACTTC<br>ATCCTGAAGATCTCTCGGGTGGAGGCAGAGGACGTGGG<br>CGTGTACTATTGTATGCAGGCCCTGGAGATCCCACTGAC<br>CTTCGGCGGAGGAACAAAGGTGGAGATCAAGACCACAA<br>CTCCTGCACCTAGGCCACCTACCCCAGCACCTACAATTG<br>CTAGTCAGCCACTGTCACTGCGACCAGAGGCATGTCGAC<br>CTGCAGCTGGAGGAGCAGTGCATACAAGGGGACTGGAC<br>TTTGCCTGCGATATCTACATTTGGGCTCCTCTGGCAGGA<br>ACATGTGGCGTGCTGCTGCTGAGCCTGGTCATCACTCTG<br>TACTGCAAGCGAGGCCGGAAGAAACTGCTGTATATTTTC<br>AAACAGCCCTTTATGCGACCTGTGCAGACCACACAGGA<br>GGAAGATGGGTGCTCCTGTCGGTTCCCCGAGGAAGAGG<br>AAGGAGGCTGTGAGCTGCGGGTCAAGTTTTCCAGATCTG<br>CAGACGCCCCTGCTTACCAGCAGGGCCAGAACCAGCTGT<br>ATAACGAGCTGAATCTGGGGCGGAGAGAGGAATACGAC<br>GTGCTGGATAAAAGGCGCGGGAGAGACCCAGAAATGGG<br>GGGAAAGCCACGACGGAAAAACCCCCAGGAGGGACTGT<br>ACAATGAACTGCAGAAGGATAAAATGGCAGAGGCCTAT<br>TCCGAAATCGGGATGAAGGGAGAAAGAAGGCGAGGCA<br>AAGGACACGACGGACTGTACCAGGGGCTGTCTACCGCC<br>ACAAAGGACACCTATGATGCTCTGCATATGCAGGCACTG<br>CCACCCAGG |
| 577 | CD8α signal sequence, 6D8 scFv, CD8α hinge and transmembrane regions, 41BB cytoplasmic signaling domain, CD3ζ cytoplasmic signaling domain | ATGGCTCTGCCCGTCACCGCTCTGCTGCTGCCTCTGGCTC<br>TGCTGCTGCACGCCGCACGACCACAGATCACACTGAAG<br>GAGAGCGGCCCAACCCTGGTGAAGCCCACCCAGACACT<br>GACCCTGACATGCACCTTCTCCGGCTTTTCTCTGAGCACC<br>AGAGGCGTGGGAGTGGGATGGATCAGACAGCCCCCTGG<br>CAAGGCCCTGGAGTGGCTGGCCCTGATCTACTGGAACGA<br>CGATAAGAGGTATTCCCCTTCTCTGCAGACACGCCTGAC<br>AATCACCAAGGACACCCCAAAGAACCAGGTGGTGCTGA<br>CAATGACCAATATGGACCCCGTGGATACAGCCACCTACT<br>ATTGTGCCCGGTCTAACTGGGGCAATTGGTACTTCGCAC<br>TGTGGGGAAGGGGCACACTGGTGACCGTGAGCTCCGGA<br>GGAGGAGGAAGCGGAGGAGGAGGGTCCGGAGGCGGGG<br>GATCTGAGATCGTGCTGACCCAGTCTCCAGCCACACTGT<br>CCCTGTCTCCCGGCGAGAGGGCCACCCTGAGCTGCAGAG<br>CCAGCCAGTCCGTGAGCTCCTACCTGGCCTGGTATCAGC<br>AGAAGCCTGGCCAGGCACCTCGGCTGCTGATCTACGACG<br>CCTTCTATAGGGCCACCGGCATCCCAGCACGCTTCTCTG<br>GAAGCGGATCCGGCACAGACTTTACCCTGACAATCTCTA<br>GCCTGGAGCCTGAGGATTTCGCCGTGTACTATTGTCAGC<br>ACCGGTCCAACTGGCCAATCACCTTTGGCCAGGGCACAA<br>GGCTGGAGATCAAGACCACAACTCCTGCACCTAGGCCA<br>CCTACCCCAGCACCTACAATTGCTAGTCAGCCACTGTCA<br>CTGCGACCAGAGGCATGTCGACCTGCAGCTGGAGGAGC<br>AGTGCATACAAGGGGACTGGACTTTGCCTGCGATATCTA |

TABLE 10-continued

Polynucleotide Sequences of exemplary DLL3 targeting CARs

| SEQ ID NO | CAR Structure | Nucleotide Sequence |
|---|---|---|
| | | CATTTGGGCTCCTCTGGCAGGAACATGTGGCGTGCTGCT GCTGAGCCTGGTCATCACTCTGTACTGCAAGCGAGGCCG GAAGAAACTGCTGTATATTTTCAAACAGCCCTTTATGCG ACCTGTGCAGACCACACAGGAGGAAGATGGGTGCTCCT GTCGGTTCCCCGAGGAAGAGGAAGGAGGCTGTGAGCTG CGGGTCAAGTTTTCCAGATCTGCAGACGCCCCTGCTTAC CAGCAGGGCCAGAACCAGCTGTATAACGAGCTGAATCT GGGGCGGAGAGAGGAATACGACGTGCTGGATAAAGGC GCGGGAGAGACCCAGAAATGGGGGGAAAGCCACGACG GAAAAACCCCCAGGAGGGACTGTACAATGAACTGCAGA AGGATAAAATGGCAGAGGCCTATTCCGAAATCGGGATG AAGGGAGAAAGAAGGCGAGGCAAAGGACACGACGGAC TGTACCAGGGGCTGTCTACCGCCACAAAGGACACCTATG ATGCTCTGCATATGCAGGCACTGCCACCCAGG |
| 578 | CD8α signal sequence, 8E11 scFv, CD8α hinge and transmembrane regions, 41BB cytoplasmic signaling domain, CD3ζ cytoplasmic signaling domain | ATGGCTCTGCCTGTCACCGCTCTGCTGCTGCCTCTGGCTC TGCTGCTGCACGCGGCGCGCCCGCAGGTGCAGCTGCAG GAGAGCGGCCCAGGCCTGGTGAAGCCATCTGAGACCCT GAGCCTGACCTGCACAGTGTCCGGCGATTCCATCTCTAA CTACTATTGGACATGGATCAGGCAGCCCCCTGGCAAGGG ACTGGAGTGGATCGGCTACATCTACTATTCTGGCACCAC AAACTCTAATCCCAGCCTGAAGAGCCGGGTGACCGTGTC CCTGGACACAAGCAAGTCCCAGTTCTCTCTGAACCTGAG CTCCGTGACCGCCGCCGATACAGCCGTGTACTATTGTGC CAGAGTGTTCAACAGAGGCTTCGCCTTTGACATCTGGGG CCAGGGCACCATGGTGACAGTGTCTAGCGGCGGCGGCG GCTCTGGAGGAGGAGGCAGCGGCGGAGGAGGCTCCGGA GGCGGCGGCTCTGAGATCGTGCTGACCCAGAGCCCCAGG CACACTGTCTCTGAGCCCCGGCGAGAGGGCCACCCTGTC CTGCCGGGCCTCTCAGAGAATCAGCAACACATACCTGGC CTGGTATCAGCAGAAGCCTGGCCAGGCCCCCAGACTGCT GATCTACGGAGCAAGCTCCAGGGCCACCGGAATCCCAG ACCGCTTCTCCGGATCTGGAAGCGGCACAGACTTCACCC TGACAATCTCCAGGCTGGAGCCTGAGGACTTCGCAGCCT ACTATTGTCAGCAGTATGATACCTCTCCACTGACATTTG GCGGCGGCACCAAGGTGGAGATCAAGACCACAACCCCA GCACCTAGGCCACCTACACCTGCACCAACCATCGCCAGC CAGCCTCTGTCCCTGAGACCAGAGGCCTGTAGGCCAGCA GCAGGAGGAGCAGTGCACACCCGGGGCCTGGACTTCGC CTGCGATATCTACATCTGGGCACCACTGGCAGGAACATG TGGCGTGCTGCTGCTGTCCCTGGTCATCACCCTGTACTGC AAGAGAGGCAGGAAGAAGCTGCTGTATATCTTCAAGCA GCCCTTCATGAGACCCGTGCAGACAACCCAGGAGGAGG ACGGCTGCAGCTGTAGGTTCCCAGAGGAGGAGGAGGGA GGATGTGAGCTGCGCGTGAAGTTTTCCCGGTCTGCCGAT GCACCTGCATACCAGCAGGGACAGAACCAGCTGTATAA CGAGCTGAATCTGGGCCGGAGAGAGGAGTACGACGTGC TGGATAAGAGGAGGGGAAGGGACCCTGAGATGGGAGGC AAGCCTCGGAGAAAGAACCCACAGGAGGGCCTGTACAA TGAGCTGCAGAAGGACAAGATGGCCGAGGCCTATAGCG AGATCGGCATGAAGGGAGAGAGGCGCCGGGGCAAGGG ACACGATGGCCTGTATCAGGGCCTGTCAACCGCTACAAA AGATACCTACGATGCTCTGCACATGCAGGCTCTGCCACC AAGA |
| 579 | CD8α signal sequence, 5C1.A4 scFv, CD8α hinge and transmembrane regions, 41BB cytoplasmic signaling domain, CD3ζ cytoplasmic signaling domain | ATGGCTCTGCCCGTCACCGCTCTGCTGCTGCCTCTGGCTC TGCTGCTGCACGCCGCACGACCACAGGTGACACTGAGG GAGTCTGGACCCGCCCTGGTGAAGCCTACCCAGACACTG ACCCTGACATGCACCGTGAGCGGCGTGTCTCTGAGCACC TCCGGCATGTGCGTGAGCTGGATCAGGCAGCCACTGGGC AAGGCCCTGGAGTGGCTGGGCTTCATCGATTGGGACGAT GACAAGTACTATAACACAAGCCTGAAGACACGCCTGAC CATCTCCAAGGACACCTCTAAGAACCAGGTGGTGCTGAC AATGACCAATATGGATCCCGTGGACACAGCCACCTACTA TTGCGCCCGGATCAGAGGCTACTCTGGCAGCTATGATGC CTTTGACATCTGGGGCCAGGGCACCGTGGTCATCGTGAG CTCCGGAGGAGGAGGAAGCGGAGGAGGAGGGTCCGGA GGCGGGGGATCTGACATCGTGATGACCCAGTCCCCTCTG TCTCTGCCCGTGACACCTGGCGAGCCAGCCTCTATCAGC TGCAGGAGCTCCCAGAGCCTGCTGCACTCCAACGGCTAC AATACCTGGATTGGTATCTGCAGAAGCCTGGCCAGTCC CCTCAGGTGCTGATCTACCTGGGCTCTAACAGGGCAAGC GGAGTGCCAGACAGATTCTCCGGATCTGGAAGCGGAAC CGACTTCACCCTGAAGATCTCTCGGGTGGAGGCAGAGG |

TABLE 10-continued

Polynucleotide Sequences of exemplary DLL3 targeting CARs

| SEQ ID NO | CAR Structure | Nucleotide Sequence |
|---|---|---|
| | | ACGTGGGCGTGTATTTCTGTATGCAGGCCCTGCAGACCC<br>CCCTGACATTTGGCGGCGGCACCAAGGTGGAGATCAAG<br>ACCACAACTCCTGCACCTAGGCCACCTACCCCAGCACCT<br>ACAATTGCTAGTCAGCCACTGTCACTGCGACCAGAGGCA<br>TGTCGACCTGCAGCTGGAGGAGCAGTGCATACAAGGGG<br>ACTGGACTTTGCCTGCGATATCTACATTTGGGCTCCTCTG<br>GCAGGAACATGTGGCGTGCTGCTGAGCCTGGTCATC<br>ACTCTGTACTGCAAGCGAGGCCGGAAGAAACTGCTGTAT<br>ATTTTCAAACAGCCCTTTATGCGACCTGTGCAGACCACA<br>CAGGAGGAAGATGGGTGCTCCTGTCGGTTCCCCGAGGA<br>AGAGGAAGGAGGCTGTGAGCTGCGGGTCAAGTTTTCCA<br>GATCTGCAGACGCCCCTGCTTACCAGCAGGGCCAGAACC<br>AGCTGTATAACGAGCTGAATCTGGGGCGGAGAGAGGAA<br>TACGACGTGCTGGATAAAAGGCGCGGGAGAGACCCAGA<br>AATGGGGGAAAGCCACGACGGAAAAACCCCCAGGAG<br>GGACTGTACAATGAACTGCAGAAGGATAAAATGGCAGA<br>GGCCTATTCCGAAATCGGGATGAAGGGAGAAAGAAGGC<br>GAGGCAAAGGACACGACGGACTGTACCAGGGGCTGTCT<br>ACCGCCACAAAGGACACCTATGATGCTCTGCATATGCAG<br>GCACTGCCACCCAGG |
| 580 | CD8α signal sequence, 9F7 scFv, CD8α hinge and transmembrane regions, 41BB cytoplasmic signaling domain, CD3ζ cytoplasmic signaling domain | ATGGCTCTGCCCGTCACCGCTCTGCTGCTGCCTCTGGCTC<br>TGCTGCTGCACGCCGCACGACCACAGGTGCAGCTGCAG<br>GTGTCCGGCCCTGGCCTGGTGAAGCCTTCCGAGACACTG<br>TCTCTGACCTGCAGCGTGTCCGGCGGCTCTATCAGCTCC<br>TACTATTGGTCTTGGATCAGGCAGAGCCCAGGCAAGGG<br>ACTGGATTGGATCGGCTACATGTACTATAGCGGCACCAC<br>AAACTATAATCCCTCTCTGAAGAGCAGAGTGACAATCAG<br>CGTGGACACCTCCAAGAACCAGTTTTCCCTGAAGCTGTC<br>TAGCGTGACCGCCACAGATACCGCCGTGTACTATTGTGC<br>CAGAGTGGGCCTGACAGGCTTCTTTTTCGACTACTGGGG<br>CCAGGGCACACTGGTGACCGTGTCCTCTGGAGGAGGAG<br>GAAGCGGAGGAGGAGGGTCCGGAGGCGGGGATCTGCC<br>ATCCAGATGACCCAGTCCCCTAGCTCCCTGAGCGCCTCC<br>GTGGGCGACAGGGTGACCATCACATGCAGAGCCTCTCA<br>GGGCATCAGGAACGATCTGGGCTGGTATCAGCAGAAGC<br>CCGGCAAGGCCCCTAAGCTGCTGATCTACGCAGCATCTA<br>GCCTGCAGTCTGGAGTGCCAAGCCGGTTCTCTGGAAGCG<br>GATCCGGCACCGACTTTACCCTGACAGTGTCCTCTCTGC<br>AGCCAGAGGACTTCGCCACATACTATTGTCTGCAGGATT<br>ACAATTATCCCTACACCTTTGGCCAGGGCACAAAGCTGG<br>AGATCAAGACCACAACTCCTGCACCTAGGCCACCTACCC<br>CAGCACCTACAATTGCTAGTCAGCCACTGTCACTGCGAC<br>CAGAGGCATGTCGACCTGCAGCTGGAGGAGCAGTGCAT<br>ACAAGGGGACTGGACTTTGCCTGCGATATCTACATTTGG<br>GCTCCTCTGGCAGGAACATGTGGCGTGCTGCTGCTGAGC<br>CTGGTCATCACTCTGTACTGCAAGCGAGGCCGGAAGAA<br>ACTGCTGTATATTTTCAAACAGCCCTTTATGCGACCTGTG<br>CAGACCACACAGGAGGAAGATGGGTGCTCCTGTCGGTT<br>CCCCGAGGAAGAGGAAGGAGGCTGTGAGCTGCGGGTCA<br>AGTTTTCCAGATCTGCAGACGCCCCTGCTTACCAGCAGG<br>GCCAGAACCAGCTGTATAACGAGCTGAATCTGGGGCGG<br>AGAGAGGAATACGACGTGCTGGATAAAAGGCGCGGGAG<br>AGACCCAGAAATGGGGGAAAGCCACGACGGAAAAAC<br>CCCCAGGAGGGACTGTACAATGAACTGCAGAAGGATAA<br>AATGGCAGAGGCCTATTCCGAAATCGGGATGAAGGGAG<br>AAAGAAGGCGAGGCAAAGGACACGACGGACTGTACCAG<br>GGGCTGTCTACCGCCACAAAGGACACCTATGATGCTCTG<br>CATATGCAGGCACTGCCACCCAGG |
| 581 | CD8α signal sequence, 2C3 scFv, CD8α hinge and transmembrane regions, 41BB cytoplasmic signaling domain, CD3ζ | ATGGCTCTGCCCGTCACCGCTCTGCTGCTGCCTCTGGCTC<br>TGCTGCTGCACGCCGCACGACCACAGGTGCAGCTGCAGC<br>AGTGGGGAGGAGGACTGCTGAAGCCCTCCGAGACCCTG<br>TCTCTGACATGCGCCGTGTACGGAGGAAGCTCCTCTGGA<br>AACTATTGGTCCTGGATCCGGCAGCCCCCTGGCAAGAGA<br>CTGGAGTGGATCGGCGAGATCAACCACAGCGGCACCAC<br>ATCCTACAATCCTTCTCTGAAGAGCAGGGTGACCATCTC<br>TGTGGACACAAGCAAGAATCAGTTCTCCCTGAAGCTGAG<br>CTCCGTGACCGCAGCAGATACAGCCGTGTACTATTGCGC<br>CAGAGGCGAGCTGGGAATCGCAGACAGCTGGGGACAGG |

TABLE 10-continued

Polynucleotide Sequences of exemplary DLL3 targeting CARs

| SEQ ID NO | CAR Structure | Nucleotide Sequence |
|---|---|---|
| | cytoplasmic signaling domain | GCACCCTGGTGACAGTGTCTAGCGGAGGAGGAGGAAGC GGAGGAGGAGGGTCCGGAGGCGGGGGATCTGATATCCA GATGACCCAGTCTCCCAGCACACTGTCCGCCTCTGTGGG CGACAGGGTGACCATCACATGTCGCGCCAGCCAGTCCAT CTCTCGGTGGCTGGCCTGGTACCAGCAGAAGCCAGGCA AGGCCCCCAAGCTGCTGATCTATAAGGCCTCCTCTCTGG AGTCCGGCGTGCCTTCTAGATTCAGCGGCTCCGGCTCTG GCACCGAGTTTACCCTGACAATCAGCTCCCTGCAGCCAG ACGATTTCGCCACCTACTATTGTCAGCAGTACAACAGCT ATTCCACCTTTGGCCAGGGCACAAAGGTGGAGATCAAG ACCACAACTCCTGCACCTAGGCCACCTACCCCAGCACCT ACAATTGCTAGTCAGCCACTGTCACTGCGACCAGAGGCA TGTCGACCTGCAGCTGGAGGAGCAGTGCATACAAGGGG ACTGGACTTTGCCTGCGATATCTACATTTGGGCTCCTCTG GCAGGAACATGTGGCGTGCTGCTGCTGAGCCTGGTCATC ACTCTGTACTGCAAGCGAGGCCGGAAGAAACTGCTGTAT ATTTTCAAACAGCCCTTTATGCGACCTGTGCAGACCACA CAGGAGGAAGATGGGTGCTCCTGTCGGTTCCCCGAGGA AGAGGAAGGAGGCTGTGAGCTGCGGGTCAAGTTTTCCA GATCTGCAGACGCCCCTGCTTACCAGCAGGGCCAGAACC AGCTGTATAACGAGCTGAATCTGGGCGGAGAGAGGAA TACGACGTGCTGGATAAAAGGCGCGGGAGAGACCCAGA AATGGGGGAAAGCCACGACGGAAAAACCCCCAGGAG GGACTGTACAATGAACTGCAGAAGGATAAAATGGCAGA GGCCTATTCCGAAATCGGGATGAAGGGAGAAAGAAGGC GAGGCAAAGGACACGACGGACTGTACCAGGGGCTGTCT ACCGCCACAAAGGACACCTATGATGCTCTGCATATGCAG GCACTGCCACCCAGG |
| 582 | CD8α signal sequence, 2G1 scFv, CD8α hinge and transmembrane regions, 41BB cytoplasmic signaling domain, CD3ζ cytoplasmic signaling domain | ATGGCTCTGCCTGTCACCGCTCTGCTGCTGCCTCTGGCTC TGCTGCTGCACGCGGCGCGCCCGCAGCTGCAGCTGCAGG AGTCCGGCCCTGGCCTGGTGAAGCCATCCGAGACCCTGT CTCTGACCTGCACAGTGAGCGGCGGTCCATCAGCTCCT CTAGCTACTATTGGGGCTGGATCAGACAGCCCCCTGGCA AGGGACTGGAGTGGATCGGCAGCATCTACTATTCCGGCA ACATCTACCACAATCCTTCTCTGAAGAGCCGCGTGTCTA TCAGCGTGGACACCTCCAAGAACCAGTTCTCTCTGAAGGC TGTCCTCTGTGACCGCAGCAGATACAGCCGTGTACTATT GCGCCAGGGAGATCATCGTGGGAGCAACCCACTTTGACT ATTGGGGCCAGGGCACCCTGGTGACAGTGAGCTCCGGC GGCGGCGGCTCTGGAGGAGGAGGCAGCGGCGGAGGAG GCTCCGGAGGCGGCGGCTCTGCCATCCAGATGACACAGT CCCCATCTAGCCTGTCCGCCTCTGTGGGCGACAGGGTGA CCATCACATGTAGAGCCAGCCAGGGCATCAGGAACGAT CTGGGCTGGTACCAGCAGAAGCCAGGCAAGGCCCCCGA GCTGCTGATCTATGCCGCCTCCTCTCTGCAGTCTGGCGTG CCAAGCAGATTCAGCGGCTCCGGCTCTGGCACCGACTTT ACCCTGACAATCAGCTCCCTGCAGCCCGAGGACTTCGCC ACATACTATTGTCTGCAGGATTACAATTATCCCCTGACC TTTGGCCCTGGCACAAAGGTGGATATCAAGACCACAACC CCAGCACCTAGGCCACCTACACCTGCACCAACCATCGCC AGCCAGCCTCTGTCCCTGAGACCAGAGGCCTGTAGGCCA GCAGCAGGAGGAGCAGTGCACACCCGGGGCCTGGACTT CGCCTGCGATATCTACATCTGGGCACCACTGGCAGGAAC ATGTGGCGTGCTGCTGCTGTCCCTGGTCATCACCCTGTA CTGCAAGAGAGGCAGGAAGAAGCTGCTGTATATCTTCA AGCAGCCCTTCATGAGACCCGTGCAGACAACCCAGGAG GAGGACGGCTGCAGCTGTAGGTTCCCAGAGGAGGAGGA GGGAGGATGTGAGCTGCGCGTGAAGTTTTCCCGGTCTGC CGATGCACCTGCATACCAGCAGGGACAGAACCAGCTGT ATAACGAGCTGAATCTGGGCCGGAGAGAGGAGTACGAC GTGCTGGATAAGAGGAGGGGAAGGGACCCTGAGATGGG AGGCAAGCCTCGAGAAAGAACCCACAGGAGGGCCTGT ACAATGAGCTGCAGAAGGACAAGATGGCCGAGGCCTAT AGCGAGATCGGCATGAAGGGAGAGAGGCGCCGGGGCA AGGGACACGATGGCCTGTATCAGGGCCTGTCAACCGCTA CAAAAGATACCTACGATGCTCTGCACATGCAGGCTCTGC CACCAAGA |
| 583 | CD8α signal sequence, 3E4 scFv, CD8α hinge and transmembrane | ATGGCTCTGCCCGTCACCGCTCTGCTGCTGCCTCTGGCTC TGCTGCTGCACGCCGCACGACCACAGGTGCAGCTGCAGC AGTGGGGAGCAGGACTGCTGAAGCCCTCCGAGACCCTG TCTCTGACATGCGCCGTGTACGGAGGAAGCTTCTCCGGA TACTATTGGTCCTGGATCAGGCAGCCCCCTGGCAAGGGA |

TABLE 10-continued

Polynucleotide Sequences of exemplary DLL3 targeting CARs

| SEQ ID NO | CAR Structure | Nucleotide Sequence |
|---|---|---|
| | e regions, 41BB cytoplasmic signaling domain, CD3ζ cytoplasmic signaling domain | CTGGAGTGGATCGGCGAGATCATCCACTCTGGCAGCTCC<br>AACTATAATCCTTCTCTGAAGAGCCGGGTGTCTATCAGC<br>GTGGACACCTCTAAGAACCAGTTCAGCCTGAAGCTGTCT<br>AGCGTGACCGCCGCCGATACAGCCGTGTACTATTGCTCC<br>AGAGGCGAGTACGGCTCCGGCTCTAGGTTTGACTATTGG<br>GGCCAGGGCACCCTGGTGACAGTGTCCTCTGGAGGAGG<br>AGGAAGCGGAGGAGGAGGGTCCGGAGGCGGGGGATCT<br>GCCATCCAGATGACCCAGTCCCCAAGCTCCCTGAGCGCC<br>TCCGTGGGCGATAGGGTGGCCATCACATGTAGGGCAAG<br>CCAGGGAATCAGGGACGATCTGGGCTGGTACCAGCAGA<br>AGCCAGGCAAGGCCCCCAAGCTGCTGATCTATGCAGCAT<br>CTAGCCTGCAGAGCGGAGTGCCATCCCGGTTCTCTGGAA<br>GCAGATCCGACACCGACTTCACCCTGACAATCTCCTCTC<br>TGCAGCCTGAGGACTTCGCCACATACTATTGTCTGCAGG<br>ACTACGATTATCCACTGACCTTTGGCGGCGGCACAAAGG<br>TGGAGATCAAGACCACAACTCCTGCACCTAGGCCACCTA<br>CCCCAGCACCTACAATTGCTAGTCAGCCACTGTCACTGC<br>GACCAGAGGCATGTCGACCTGCAGCTGGAGGAGCAGTG<br>CATACAAGGGGACTGGACTTTGCCTGCGATATCTACATT<br>TGGGCTCCTCTGGCAGGAACATGTGGCGTGCTGCTGCTG<br>AGCCTGGTCATCACTCTGTACTGCAAGCGAGGCCGGAAG<br>AAACTGCTGTATATTTTCAAACAGCCCTTTATGCGACCT<br>GTGCAGACCACACAGGAGGAAGATGGGTGCTCCTGTCG<br>GTTCCCCGAGGAAGAGGAAGGAGGCTGTGAGCTGCGGG<br>TCAAGTTTTCCAGATCTGCAGACGCCCCTGCTTACCAGC<br>AGGGCCAGAACCAGCTGTATAACGAGCTGAATCTGGGG<br>CGGAGAGAGGAATACGACGTGCTGGATAAAAGGCGCGG<br>GAGAGACCCAGAAATGGGGGGAAAGCCACGACGGAAA<br>AACCCCCAGGAGGGACTGTACAATGAACTGCAGAAGGA<br>TAAAATGGCAGAGGCCTATTCCGAAATCGGGATGAAGG<br>GAGAAAGAAGGCGAGGCAAAGGACACGACGGACTGTA<br>CCAGGGGCTGTCTACCGCCACAAAGGACACCTATGATGC<br>TCTGCATATGCAGGCACTGCCACCCAGG |
| 584 | CD8α signal sequence, 3F2 scFv, CD8α hinge and transmembrane regions, 41BB cytoplasmic signaling domain, CD3ζ cytoplasmic signaling domain | ATGGCTCTGCCTGTCACCGCTCTGCTGCTGCCTCTGGCTC<br>TGCTGCTGCACGCGGCGCGCCCGCAGGTGCAGCTGCAG<br>GAGTCCGGCCCTGGCCTGGTGAAGCCAAGCGGCACCCT<br>GTCCCTGACATGCGCCGTGTCTGGCGGCAGCATCAGCTC<br>CAACAATTGGTGGAGCTGGGTGAGGCAGCCCCCTGGCA<br>AGGGACTGGAGTGGATCGGCGACATCCACCACTCCGGC<br>TCTACCAACTACAAGCCATCCCTGAAGTCTCGCGTGACA<br>ATCTCTGTGGACAAGAGCAAGAACCAGTTCTCCCTGAAT<br>CTGATCAGCGTGACCGCCGCCGATACAGCCGTGTACTAT<br>TGCGCCAGAGAGGCCGGCGGCTACTTTGACTATTGGGGC<br>CAGGGCATCCTGGTGACCGTGTCTAGCGGCGGCGGCGG<br>CTCTGGAGGAGGAGGCAGCGGCGGAGGAGGCTCCGGAG<br>GCGGCGGCTCTGATATCCAGATGACCCAGAGCCCATCCA<br>CACTGTCTGCCAGCGTGGGCGACAGGGTGACCATCACAT<br>GTAGAGCCTCCCAGTCTATCTCCTCTTGGCTGGCCTGGT<br>ATCAGCAGAAGCCAGGCAAGGCCCCCAAGCTGCTGATC<br>AGCAAGGCAAGCTCCCTGGAGTCCGGAGTGCCATCTAG<br>GTTCAGCGGATCCGGCTCTGGCCCTGAGTTTACCCTGAC<br>AATCTCTAGCCTGCAGCCTGCCGATTTCGCCACCTACTA<br>TTGTCAGCAGTACAATAGCTATTCCACCTTTGGCCAGGG<br>CACAAAGCTGGAGATCAAGACCACAACCCCAGCACCTA<br>GGCCACCTACACCTGCACCAACCATCGCCAGCCAGCCTC<br>TGTCCCTGAGACCAGAGGCCTGTAGGCCAGCAGCAGGA<br>GGAGCAGTGCACACCCGGGCCTGGACTTCGCCTGCGAT<br>ATCTACATCTGGGCACCACTGGCAGGAACATGTGGCGTG<br>CTGCTGCTGTCCCTGGTCATCACCCTGTACTGCAAGAGA<br>GGCAGGAAGAAGCTGCTGTATATCTTCAAGCAGCCCTTC<br>ATGAGACCCGTGCAGACAACCCAGGAGGAGGACGGCTG<br>CAGCTGTAGGTTCCCAGAGGAGGAGGAGGGAGGATGTG<br>AGCTGCGCGTGAAGTTTTCCCGGTCTGCCGATGCACCTG<br>CATACCAGCAGGGACAGAACCAGCTGTATAACGAGCTG<br>AATCTGGGCCGGAGAGAGGAGTACGACGTGCTGGATAA<br>GAGGAGGGGAAGGGACCCTGAGATGGGAGGCAAGCCTC<br>GGAGAAAGAACCCACAGGAGGGCCTGTACAATGAGCTG<br>CAGAAGGACAAGATGGCCGAGGCCTATAGCGAGATCGG<br>CATGAAGGGAGAGAGGCGCCGGGGCAAGGGACACGAT<br>GGCCTGTATCAGGGCCTGTCAACCGCTACAAAAGATACC<br>TACGATGCTCTGCACATGCAGGCTCTGCCACCAAGA |

TABLE 10-continued

Polynucleotide Sequences of exemplary DLL3 targeting CARs

| SEQ ID NO | CAR Structure | Nucleotide Sequence |
|---|---|---|
| 585 | CD8α signal sequence, 4F9 scFv, CD8α hinge and transmembrane regions, 41BB cytoplasmic signaling domain, CD3ζ cytoplasmic signaling domain | ATGGCTCTGCCCGTCACCGCTCTGCTGCTGCCTCTGGCTC TGCTGCTGCACGCCGCACGACCACAGGTGCAGCTGCAGC AGTGGGGAGCAGGACTGCTGAAGCCCTCCGAGACCCTG TCTCTGACATGCGCCGTGTACGGCGGCTCCTTCTCTGGCT ACTATTGGACCTGGATCAGACAGCCCCCTGGCAAGGGA CTGGAGTGGATCGGCGAGATCACCCACAGCGGCTCCAC AAACTATAATCCTTCTCTGAAGAGCAGGGTGTCTATCAG CGTGGACACCTCTAAGAACCAGTTCAGCCTGAAGCTGAG CTCCGTGACCGCAGCAGATACAGCCGTGTACTATTGCGC CAGAGGCGAGTACGGATCCGGATCTCGGTTTGACTATTG GGGCCAGGGCACCCTGGTGACAGTGTCTAGCGGAGGAG GAGGAAGCGGAGGAGGAGGGTCCGGAGGCGGGGGATC TGCCATCCAGATGACCCAGTCCCCATCCTCTCTGAGCGC CTCCGTGGGCGATAGGGTGGCAATCACATGTAGAGCCA GCCAGGGCATCAGGGACGATCTGGGCTGGTACCAGCAG AAGCCAGGCAAGGCCCCCAAGCTGCTGATCTATGCAGC AAGCTCCCTGCAGAGCGGAGTGCCATCCAGATTCTCTGG CAGCGGCTCCGACACCGACTTCACCCTGACAATCTCTAG CCTGCAGCCTGAGGACTTCGCCACATACTATTGTCTGCA GGACTACGATTATCCACTGACCTTTGGCGGCGGCACAAA GGTGGAGATCAAGACCACAACTCCTGCACCTAGGCCAC CTACCCCAGCACCTACAATTGCTAGTCAGCCACTGTCAC TGCGACCAGAGGCATGTCGACCTGCAGCTGGAGGAGCA GTGCATACAAGGGGACTGGACTTTGCCTGCGATATCTAC ATTTGGGCTCCTCTGGCAGGAACATGTGGCGTGCTGCTG CTGAGCCTGGTCATCACTCTGTACTGCAAGCGAGGCCGG AAGAAACTGCTGTATATTTTCAAACAGCCCTTTATGCGA CCTGTGCAGACCACACAGGAGGAAGATGGGTGCTCCTG TCGGTTCCCCGAGGAAGAGGAAGGAGGCTGTGAGCTGC GGGTCAAGTTTTCCAGATCTGCAGACGCCCCTGCTTACC AGCAGGGCCAGAACCAGCTGTATAACGAGCTGAATCTG GGGCGGAGAGAGGAATACGACGTGCTGGATAAAAGGCG CGGGAGAGACCCAGAAATGGGGGGAAAGCCACGACGG AAAAACCCCCAGGAGGGACTGTACAATGAACTGCAGAA GGATAAAATGGCAGAGGCCTATTCCGAAATCGGGATGA AGGGAGAAAGAAGGCGAGGCAAAGGACACGACGGACT GTACCAGGGGCTGTCTACCGCCACAAAGGACACCTATG ATGCTCTGCATATGCAGGCACTGCCACCCAGG |
| 586 | CD8α signal sequence, 4G9 scFv, CD8α hinge and transmembrane regions, 41BB cytoplasmic signaling domain, CD3ζ cytoplasmic signaling domain | ATGGCTCTGCCCGTCACCGCTCTGCTGCTGCCTCTGGCTC TGCTGCTGCACGCCGCACGACCACAGGTGCAGCTGCAGC AGTGGGGAGCAGGACTGCTGAAGCCCTCCGAGACCCTG TCTCTGACATGCGCCGTGTACGGCGGCTCCTTCTCTGGCT ACTATTGGTCCTGGATCAGACAGCCCCCTGGCAAGGGAC TGGAGTGGATCGGCGAGATCACCCACAGCGGCTCCACA AACTATAATCCTTCTCTGAAGAGCAGGGTGTCTATCAGC GTGGACACCTCTAAGAACCAGTTCAGCCTGAAGCTGAGC TCCGTGACCGCAGCAGATACAGCCGTGTACTATTGCGCC AGAGGCGAGTACGGATCCGGATCTCGGTTTGACTATTGG GGCCAGGGCACCCTGGTGACAGTGTCTAGCGGAGGAGG AGGAAGCGGAGGAGGAGGGTCCGGAGGCGGGGGATCT GCCATCCAGATGACCCAGTCCCCATCCTCTCTGAGCGCC TCCGTGGGCGATAGGGTGGCCCTGACATGTAGAGCCAG CCAGGGCATCAGGGACGATCTGGGCTGGTACCAGCAGA AGCCAGGCAAGGCCCCCAAGCTGCTGATCTATGCAGCA AGCTCCCTGCAGAGCGGAGTGCCATCCAGATTCTCTGGC AGCGGCTCCGACACCGACTTCACCCTGACAATCTCTAGC CTGCAGCCTGAGGACTTCGCCACATACTATTGTCTGCAG GACTACGATTATCCACTGACCTTTGGCGGCGGCACAAAG GTGGAGATCAAGACCACAACTCCTGCACCTAGGCCACCT ACCCCAGCACCTACAATTGCTAGTCAGCCACTGTCACTG CGACCAGAGGCATGTCGACCTGCAGCTGGAGGAGCAGT GCATACAAGGGGACTGGACTTTGCCTGCGATATCTACAT TTGGGCTCCTCTGGCAGGAACATGTGGCGTGCTGCTGCT GAGCCTGGTCATCACTCTGTACTGCAAGCGAGGCCGGAA GAAACTGCTGTATATTTTCAAACAGCCCTTTATGCGACC TGTGCAGACCACACAGGAGGAAGATGGGTGCTCCTGTC GGTTCCCCGAGGAAGAGGAAGGAGGCTGTGAGCTGCGG GTCAAGTTTTCCAGATCTGCAGACGCCCCTGCTTACCAG CAGGGCCAGAACCAGCTGTATAACGAGCTGAATCTGGG GCGGAGAGAGGAATACGACGTGCTGGATAAAAGGCGCG GGAGAGACCCAGAAATGGGGGGAAAGCCACGACGGAA AAACCCCCAGGAGGGACTGTACAATGAACTGCAGAAGG |

TABLE 10-continued

Polynucleotide Sequences of exemplary DLL3 targeting CARs

| SEQ ID NO | CAR Structure | Nucleotide Sequence |
|---|---|---|
| | | ATAAAATGGCAGAGGCCTATTCCGAAATCGGGATGAAG GGAGAAAGAAGGCGAGGCAAAGGACACGACGGACTGT ACCAGGGGCTGTCTACCGCCACAAAGGACACCTATGAT GCTCTGCATATGCAGGCACTGCCACCCAGG |
| 587 | CD8α signal sequence, 11H7 scFv, CD8α hinge and transmembrane regions, 41BB cytoplasmic signaling domain, CD3ζ cytoplasmic signaling domain | ATGGCTCTGCCCGTCACCGCTCTGCTGCTGCCTCTGGCTC TGCTGCTGCACGCCGCACGACCACAGGTGCAGCTGCAGC AGTGGGGAGCAGGACTGCTGAAGCCTTCTGAGACCCTG AGCCTGACATGCGCCGTGTACGGCGGCAGCTTTTCCGCC TACTATTGGAACTGGATCGGCAGCCCCCTGGCAAGGG ACTGGAGTGGATCGGCGAGATCAATCACTCTGGCAGCA CCAACTATAATCCCAGCCTGAAGTCCCGCGTGACCATCT CCGTGGACACATCTAAGAACCAGTTTTCTCTGAATCTGA CCAGCCTGACAGCCGCCGATACAGCCGTGTACTATTGCG CCAGAGGCCTGGACAGCTCCGGATGGTACCCATTCGATT ATTGGGGCCAGGGCACCCTGGTGACAGTGTCTAGCGGA GGAGGAGGAAGCGGAGGAGGAGGGTCCGGAGGCGGGG GATCTGACATCCAGATGACCCAGTCCCCATCCAGCGTGA GCGCCTCTGTGGGCGATAGGGTGACCATCACATGTAGAG CAAGCCAGGGAATCAGCTCCTGGCTGGCATGGTACCAG CAGAAGCCAGGCAAGGCCCCCAAGCTGCTGATCTATGC AGCATCTAGCCTGCAGAGCGGAGTGCCATCCAGGTTTAG CGGATCCGGATCTGGAACCGACTTCACCCTGACAATCTC CTCTCTGCAGCCTGAGGACTTCGCCACATACTATTGTCA GCAGGCCGATTCCTTCCCTTTTACCTTCGGCCCAGGCAC AAAGGTGGATATCAAGACCACAACTCCTGCACCTAGGC CACCTACCCCAGCACCTACAATTGCTAGTCAGCCACTGT CACTGCGACCAGAGGCATGTCGACCTGCAGCTGGAGGA GCAGTGCATACAAGGGGACTGGACTTTGCCTGCGATATC TACATTTGGGCTCCTCTGGCAGGAACATGTGGCGTGCTG CTGCTGAGCCTGGTCATCACTCTGTACTGCAAGCGAGGC CGGAAGAAACTGCTGTATATTTTCAAACAGCCCTTTATG CGACCTGTGCAGACCACACAGGAGGAAGATGGGTGCTC CTGTCGGTTCCCCGAGGAAGAGGAAGGAGGCTGTGAGC TGCGGGTCAAGTTTTCCAGATCTGCAGACGCCCCTGCTT ACCAGCAGGGCCAGAACCAGCTGTATAACGAGCTGAAT CTGGGGCGGAGAGAGGAATACGACGTGCTGGATAAAAG GCGCGGGAGAGACCCAGAAATGGGGGGAAAGCCACGA CGGAAAAACCCCCAGGAGGGACTGTACAATGAACTGCA GAAGGATAAAATGGCAGAGGCCTATTCCGAAATCGGGA TGAAGGGAGAAAGAAGGCGAGGCAAAGGACACGACGG ACTGTACCAGGGGCTGTCTACCGCCACAAAGGACACCTA TGATGCTCTGCATATGCAGGCACTGCCACCCAGG |
| 588 | CD8α signal sequence, 16H7 scFv, CD8α hinge and transmembrane regions, 41BB cytoplasmic signaling domain, CD3ζ cytoplasmic signaling domain | ATGGCTCTGCCCGTCACCGCTCTGCTGCTGCCTCTGGCTC TGCTGCTGCACGCCGCACGACCACAGGTGCAGCTGCAGC AGTGGGGAGCAGGACTGCTGAAGCCAAGCGAGACCCTG TCCCTGACATGCGCCGTGTTCGGCGGCTCTTTTAGCGGC GACTACTGGAGCTGGATCGGCAGCCCCCTGGCAAGGG ACTGGAGTGGATCGGCGAGATCAACCACTCTGGCATCAC CAGCTTCAATCCCTCCCTGAAGTCTCGCGTGACCATCTC CGTGGACACATCTAAGAACCAGTTTTCCCTGAAGCTGAG CTCCGTGACCGCAGCAGATACAGCCGTGTACTATTGCGC CAGAGGCGAGCTGGGCATCCCTGACAATTGGGGCCAGG GCACCCTGGTGACAGTGTCTAGCGGAGGAGGAGGAAGC GGAGGAGGAGGGTCCGGAGGCGGGGATCTGATATCCA GATGACCCAGTCCCCATCTACACTGAGCGCTCCGTGGG CGATAGGGTGACCATCACATGTAGAGCCTCTCAGAGCAT CTCCCGGTGGCTGGCCTGGTACCAGCAGAAGCCAGGCA AGGCCCCCAAGCTGCTGATCTATAAGGCATCCTCTCTGG AGAGCGGAGTGCCATCCAGGTTCTCTGGAAGCGGATCC GGAACCGAGTTTACCCTGACAATCAGCTCCCTGCAGCCT GACGATTTCGCCACATACTATTGTCAGCAGTACAACTCT TATAGCACCTTTGGCCAGGGCACAAAGGTGGAGATCAA GACCACAACTCCTGCACCTAGGCCACCTACCCCAGCACC TACAATTGCTAGTCAGCCACTGTCACTGCGACCAGAGGC ATGTCGACCTGCAGCTGGAGGAGCAGTGCATACAAGGG GACTGGACTTTGCCTGCGATATCTACATTTGGGCTCCTCT GGCAGGAACATGTGGCGTGCTGCTGCTGAGCCTGGTCAT CACTCTGTACTGCAAGCGAGGCCGGAAGAAACTGCTGT ATATTTTCAAACAGCCCTTTATGCGACCTGTGCAGACCA CACAGGAGGAAGATGGGTGCTCCTGTCGGTTCCCCGAG GAAGAGGAAGGAGGCTGTGAGCTGCGGGTCAAGTTTTC CAGATCTGCAGACGCCCCTGCTTACCAGCAGGGCCAGA |

TABLE 10-continued

Polynucleotide Sequences of exemplary DLL3 targeting CARs

| SEQ ID NO | CAR Structure | Nucleotide Sequence |
|---|---|---|
| | | ACCAGCTGTATAACGAGCTGAATCTGGGGCGGAGAGAG<br>GAATACGACGTGCTGGATAAAAGGCGCGGGAGAGACCC<br>AGAAATGGGGGGAAAGCCACGACGGAAAAACCCCCAG<br>GAGGGACTGTACAATGAACTGCAGAAGGATAAAATGGC<br>AGAGGCCTATTCCGAAATCGGGATGAAGGGAGAAAGAA<br>GGCGAGGCAAAGGACACGACGGACTGTACCAGGGGCTG<br>TCTACCGCCACAAAGGACACCTATGATGCTCTGCATATG<br>CAGGCACTGCCACCCAGG |
| 589 | CD8α signal sequence, 17A2 scFv, CD8α hinge and transmembrane regions, 41BB cytoplasmic signaling domain, CD3ζ cytoplasmic signaling domain | ATGGCTCTGCCTGTCACCGCTCTGCTGCTGCCTCTGGCTC<br>TGCTGCTGCACGCGGCGCGCCCGCAGGTGCAGCTGCAG<br>GAGTCCGGCCCTGGCCTGGTGAAGCCATCCGGCACCCTG<br>TCTCTGACATGCGTGGTGTTCGGCGACAGCATCAGCTCC<br>TCTAACTGGTGGTCCTGGGTGAGGCAGCCCCCTGGCAAG<br>GGACTGGAGTGGATCGGCGAGGTGTTCCACTCCGGCTCT<br>ACCAACTACAATCCAAGCCTGAAGTCCCGCGTGACAATC<br>AGCGTGGATAAGTCCAAGAATCAGTTTAGCCTGAAGCTG<br>AGCTCCGTGACCGCAGCAGACACAGCCGTGTACTATTGC<br>GCCAGAGCCGCAGTGGCAGGCGCCCTGGATTATTGGGG<br>ACAGGGCACCCTGGTGACAGTGTCTAGCGGCGGCGGCG<br>GCTCTGGAGGAGGAGGCAGCGGCGGAGGAGGCTCCGGA<br>GGCGGCGGCTCTGACATCGTGATGACCCAGTCTCCCGAT<br>AGCCTGGCCGTGTCTCTGGGCGAGAGGGCAACAATCAA<br>CTGTAAGTCCTCTCAGAGCGTGCTGTACAGCTCCAACAA<br>TAAGAACTACCTGGCCTGGTATCAGCAGAAGCCTGGCCA<br>GCCACCCAATCTGCTGGTGTATTGGGCCTCTACCAGAGA<br>GAGCGGAGTGCCTGACAGATTCTCCGGAGCAGGATCTG<br>GAACAGACTTCACCCTGACAATCTCTAGCCTGCAGGCCG<br>AGGACGTGGCCGTGTACTATTGTCAGCAGTACTATGGCA<br>CCTCCTGGACATTTGGCCAGGGCACCAAGGTGGAGATCA<br>AGACCACAACCCCAGCACCTAGGCCACCTACACCTGCAC<br>CAACCATCGCCAGCCAGCCTCTGTCCCTGAGACCAGAGG<br>CCTGTAGGCCAGCAGCAGGAGGAGCAGTGCACACCCGG<br>GGCCTGGACTTCGCCTGCGATATCTACATCTGGGCACCA<br>CTGGCAGGAACATGTGGCGTGCTGCTGCTGTCCCTGGTC<br>ATCACCCTGTACTGCAAGAGAGGCAGGAAGAAGCTGCT<br>GTATATCTTCAAGCAGCCCTTCATGAGACCCGTGCAGAC<br>AACCCAGGAGGAGGACGGCTGCAGCTGTAGGTTCCCAG<br>AGGAGGAGGAGGGAGGATGTGAGCTGCGCGTGAAGTTT<br>TCCCGGTCTGCCGATGCACCTGCATACCAGCAGGGACAG<br>AACCAGCTGTATAACGAGCTGAATCTGGGCCGGAGAGA<br>GGAGTACGACGTGCTGGATAAGAGGAGGGAAGGGACC<br>CTGAGATGGGAGGCAAGCCTCGGAGAAAGAACCCACAG<br>GAGGGCCTGTACAATGAGCTGCAGAAGGACAAGATGGC<br>CGAGGCCTATAGCGAGATCGGCATGAAGGGAGAGAGGC<br>GCCGGGGCAAGGGACACGATGGCCTGTATCAGGGCCTG<br>TCAACCGCTACAAAAGATACCTACGATGCTCTGCACATG<br>CAGGCTCTGCCACCAAGA |
| 590 | CD8α signal sequence, 6H1 scFv, CD8α hinge and transmembrane regions, 41BB cytoplasmic signaling domain, CD3ζ cytoplasmic signaling domain | ATGGCTCTGCCCGTCACCGCTCTGCTGCTGCCTCTGGCTC<br>TGCTGCTGCACGCCGCACGACCACAGATCACACTGAGG<br>GAGAGCGGCCCTACCCTGGTGAAGCCAACCCAGACACT<br>GACCCTGACATGCACCTTTTCCGGCTTCTCCCTGTCTACC<br>AGCGGCCTGGGCGTGGGATGGATCAGGCAGCCCCCTGG<br>CGAGGCCCTGGAGTGGCTGGCCCTGATCTACTGGAACGA<br>CGATAAGCGGTATTCCCCCTCTCTGAAGTCTAGACTGAG<br>CATCACAAAGGACACCTCCAAGAACCAGGTGGTGCTGA<br>TCATGACAAATATGGACCCAGTGGATACAGCCACCTACT<br>ATTGCGTGCACAGGAGAATCGCAGCCCCTGGCAGCGTGT<br>ACTGGGGACAGGGCACACTGGTGACCGTGAGCTCCGGA<br>GGAGGAGGAAGCGGAGGAGGAGGGTCCGGAGGCGGGG<br>GATCTGACATCCAGATGACCCAGTCTCCTTCTAGCGTGA<br>GCGCCTCCGTGGGCGATAGGGTGACAATCACCTGTCGCG<br>CCAGCCAGGGCATCTCCTCTTGGCTGGCCTGGTATCAGC<br>AGAAGCCAGGCAAGGCACCAAAGCTGCTGATCAGCGCC<br>GCAAGCTCCCTGCAGTCCGGAGTGCCATCTCGGTTTTCT<br>GGCAGCGGCTCCGGCACAGACTTCACACTGACCATCTCT<br>AGCCTGCAGCCCGAGGATTTTGCCACCTACTATTGTCAC<br>CAGGCCAATTCCTTCCCTTTTACATTCGGCCAGGGCACC<br>AAGCTGGAGATCAAGACCACAACTCCTGCACCTAGGCC<br>ACCTACCCCAGCACCTACAATTGCTAGTCAGCCACTGTC<br>ACTGCGACCAGAGGCATGTCGACCTGCAGCTGGAGGAG<br>CAGTGCATACAAGGGGACTGGACTTTGCCTGCGATATCT<br>ACATTTGGGCTCCTCTGGCAGGAACATGTGGCGTGCTGC |

TABLE 10-continued

Polynucleotide Sequences of exemplary DLL3 targeting CARs

| SEQ ID NO | CAR Structure | Nucleotide Sequence |
|---|---|---|
| | | TGCTGAGCCTGGTCATCACTCTGTACTGCAAGCGAGGCC GGAAGAAACTGCTGTATATTTTCAAACAGCCCTTTATGC GACCTGTGCAGACCACACAGGAGGAAGATGGGTGCTCC TGTCGGTTCCCCGAGGAAGAGGAAGGAGGCTGTGAGCT GCGGGTCAAGTTTTCCAGATCTGCAGACGCCCCTGCTTA CCAGCAGGGCCAGAACCAGCTGTATAACGAGCTGAATC TGGGGCGGAGAGAGGAATACGACGTGCTGGATAAAAGG CGCGGGAGAGACCCAGAAATGGGGGAAAGCCACGAC GGAAAAACCCCCAGGAGGGACTGTACAATGAACTGCAG AAGGATAAAATGGCAGAGGCCTATTCCGAAATCGGGAT GAAGGGAGAAAGAAGGCGAGGCAAAGGACACGACGGA CTGTACCAGGGGCTGTCTACCGCCACAAAGGACACCTAT GATGCTCTGCATATGCAGGCACTGCCACCCAGG |
| 591 | CD8α signal sequence, 6H5 scFv, CD8α hinge and transmembrane regions, 41BB cytoplasmic signaling domain, CD3ζ cytoplasmic signaling domain | ATGGCTCTGCCCGTCACCGCTCTGCTGCTGCCTCTGGCTC TGCTGCTGCACGCCGCACGACCACAGGTGCAGCTGGTGC AGTCCGGAGCAGAGGTGAAGAAGCCTGGCGCCTCCGTG AAGGTGTCTTGCAAGGTGAGCGGCTACACCCTGACAGA GCTGTCTATGCACTGGGTGCGCCAGGCCCCCGGCAAGGG ACCTGAGGGAATGGGAGGATTCGACCCTGAGGATGGCA AGACAATCTACGCCCAGAAGTTTCAGGGCCGGGTGACC ATGACAGAGGACACCAGCGCCGATACAGCCTATATGGA GCTGAACTCTCTGCGCAGCGAGGACACCGCCGTGTACTA TTGCGCCACACTGCTGAGGGGACTGGACGCCTTCGACGT GTGGGGACAGGGAACCATGGTGACAGTGAGCTCCGGAG GAGGAGGAAGCGGAGGAGGAGGGTCCGGAGGCGGGGG ATCTGATATCCAGATGACCCAGTCTCCATCTAGCCTGAG CGCCTCCGTGGGCGACAGGGTGACCATCACATGTAGAG CCAGCCAGGGCATCAGGAACGATCTGGGCTGGTACCAG CAGAAGCCAGGCAAGGCCCCCAAGAGACTGATCTATGC AGCATCCTCTCTGCAGTCCGGAGTGCCATCTAGGTTCTC TGGCAGCGGCTCCGGCACCGAGTTTACCCTGACAATCAG CACACTGCAGCCTGAGGACTTCGCCACCTACTATTGTCT GCAGCACAATTCCTATCCACGGACCTTTGGCCAGGGCAC AAAGGTGGAGATCAAGACCACAACTCCTGCACCTAGGC CACCTACCCCAGCACCTACAATTGCTAGTCAGCCACTGT CACTGCGACCAGAGGCATGTCGACCTGCAGCTGGAGGA GCAGTGCATACAAGGGGACTGGACTTTGCCTGCGATATC TACATTTGGGCTCCTCTGGCAGGAACATGTGGCGTGCTG CTGCTGAGCCTGGTCATCACTCTGTACTGCAAGCGAGGC CGGAAGAAACTGCTGTATATTTTCAAACAGCCCTTTATG CGACCTGTGCAGACCACACAGGAGGAAGATGGGTGCTC CTGTCGGTTCCCCGAGGAAGAGGAAGGAGGCTGTGAGC TGCGGGTCAAGTTTTCCAGATCTGCAGACGCCCCTGCTT ACCAGCAGGGCCAGAACCAGCTGTATAACGAGCTGAAT CTGGGGCGGAGAGAGGAATACGACGTGCTGGATAAAAG GCGCGGGAGAGACCCAGAAATGGGGGGAAAGCCACGA CGGAAAAACCCCCAGGAGGGACTGTACAATGAACTGCA GAAGGATAAAATGGCAGAGGCCTATTCCGAAATCGGGA TGAAGGGAGAAAGAAGGCGAGGCAAAGGACACGACGG ACTGTACCAGGGGCTGTCTACCGCCACAAAGGACACCTA TGATGCTCTGCATATGCAGGCACTGCCACCCAGG |
| 592 | CD8α signal sequence, 10D1 scFv, CD8α hinge and transmembrane regions, 41BB cytoplasmic signaling domain, CD3ζ cytoplasmic signaling domain | ATGGCTCTGCCCGTCACCGCTCTGCTGCTGCCTCTGGCTC TGCTGCTGCACGCCGCACGACCACAGGTGCAGCTGCAGC AGTGGGGAGCAGGACTGCTGAAGCCATCCGAGACCCTG TCTCTGACATGCGCCGTGTATGGCGGCTCCTTCTCTGGCT ACTATTGGCGGTGGATCAGACAGCCCCCTGGCAAGGGA CTGGAGTGGATCGGCGAGATCAGCCACTCCGGCTCTACC AACTACAATCCCTCTCTGAAGAGCCGCGTGACCATCAGC GTGGACACATCCAAGAACCAGTTCAGCCTGAAGCTGAG CTCCGTGACCGCAGCAGATACAGCCGTGTACTATTGCGC CGTGCGGGGCTACTCCTATGGCTACCCCCTGTTTGACTA CTGGGGCCAGGGCACCCTGGTGACAGTGTCTAGCGGAG GAGGAGGAAGCGGAGGAGGAGGGTCCGGAGGCGGGGG ATCTGATATCCAGATGACCCAGTCCCCTTCCTCTCTGAG CGCCTCCGTGGGCGACAGGGTGACCATCACATGTCGCGC TCTCAGGGCATCCGGAACGATCTGGGCTGGTATCAGCA GAAGCTGGGCAAGGCCCCAAAGAGACTGATCTACGCAG CAAGCTCCCTGCAGTCTGGAGTGCCAAGCAGGTTCTCTG GAAGCGGATCCGGAACCGAGTTTACCCTGACAATCTCTA GCCTGCAGCCTGAGGACTTCGCCACATACTATTGTCTGC AGTATAATAGCTACCCACGGACCTTTGGCCAGGGCACAA AGGTGGAGATCAAGACCACAACTCCTGCACCTAGGCCA |

TABLE 10-continued

Polynucleotide Sequences of exemplary DLL3 targeting CARs

| SEQ ID NO | CAR Structure | Nucleotide Sequence |
|---|---|---|
| | | CCTACCCCAGCACCTACAATTGCTAGTCAGCCACTGTCA<br>CTGCGACCAGAGGCATGTCGACCTGCAGCTGGAGGAGC<br>AGTGCATACAAGGGGACTGGACTTTGCCTGCGATATCTA<br>CATTTGGGCTCCTCTGGCAGGAACATGTGGCGTGCTGCT<br>GCTGAGCCTGGTCATCACTCTGTACTGCAAGCGAGGCCG<br>GAAGAAACTGCTGTATATTTTCAAACAGCCCTTTATGCG<br>ACCTGTGCAGACCACACAGGAGGAAGATGGGTGCTCCT<br>GTCGGTTCCCCGAGGAAGAGGAAGGAGGCTGTGAGCTG<br>CGGGTCAAGTTTTCCAGATCTGCAGACGCCCCTGCTTAC<br>CAGCAGGGCCAGAACCAGCTGTATAACGAGCTGAATCT<br>GGGGCGGAGAGAGGAATACGACGTGCTGGATAAAAGGC<br>GCGGGAGAGACCCAGAAATGGGGGGAAAGCCACGACG<br>GAAAAACCCCAGGAGGGACTGTACAATGAACTGCAGA<br>AGGATAAAATGGCAGAGGCCTATTCCGAAATCGGGATG<br>AAGGGAGAAAGAAGGCGAGGCAAAGGACACGACGGAC<br>TGTACCAGGGGCTGTCTACCGCCACAAAGGACACCTATG<br>ATGCTCTGCATATGCAGGCACTGCCACCCAGG |
| 593 | CD8α signal sequence, 11F6 scFv, CD8α hinge and transmembrane regions, 41BB cytoplasmic signaling domain, CD3ζ cytoplasmic signaling domain | ATGGCTCTGCCCGTCACCGCTCTGCTGCTGCCTCTGGCTC<br>TGCTGCTGCACGCCGCACGACCACAGGTGCAGCTGCAG<br>GAGAGCGGCCCTGGCCTGGTGAAGCCATCCGGCACCCT<br>GTCTCTGACATGCGCCGTGAGCGGCGACTCCATCAGCTC<br>CAACTGGTGGACATGGGTGAGGCAGCCCCCTGGCAAGG<br>GACTGGAGTGGATCGGCGATATCCACCACTCCGGCTCTA<br>CCAACTACAATCCATCTCTGAAGAGCCGCGTGACAATGA<br>GCGTGGACAAGTCCGAGAATCAGTTCTCCCTGAAGCTGT<br>CTAGCGTGACCGCCGCCGATACAGCCGTGTTTTACTGCG<br>CCAGAGACGGAGGAGGCACCCTGGATTATTGGGGCCAG<br>GGCACCCTGGTGACAGTGTCCTCTGGAGGAGGAGGAAG<br>CGGAGGAGGAGGGTCCGGAGGCGGGGGATCTGACATCC<br>AGATGACCCAGAGCCCATCCACACTGTCTGCCAGCGTGG<br>GCGATCGGGTGACCATCACATGTAGAGCCTCCCAGTCTA<br>TCAGCTCCTGGCTGGCCTGGTACCAGCAGAAGCCAGGCA<br>AGGCCCCCAAGCTGCTGATCTATAAGGCATCTACCCTGG<br>AGAGCGGAGTGCCATCCAGGTTCAGCGGATCCGGATCT<br>GGCACAGAGTTTACCCTGACAATCTCTAGCCTGCAGCCT<br>GACGATTTCGCCACCTACTATTGTCAGCAGTACAACGGC<br>TATAGCACCTTTGGCCAGGGCACAAAGGTGGAGATCAA<br>GACCACAACTCCTGCACCTAGGCCACCTACCCCAGCACC<br>TACAATTGCTAGTCAGCCACTGTCACTGCGACCAGAGGC<br>ATGTCGACCTGCAGCTGGAGGAGCAGTGCATACAAGGG<br>GACTGGACTTTGCCTGCGATATCTACATTTGGGCTCCTCT<br>GGCAGGAACATGTGGCGTGCTGCTGCTGAGCCTGGTCAT<br>CACTCTGTACTGCAAGCGAGGCCGGAAGAAACTGCTGT<br>ATATTTTCAAACAGCCCTTTATGCGACCTGTGCAGACCA<br>CACAGGAGGAAGATGGGTGCTCCTGTCGGTTCCCCGAG<br>GAAGAGGAAGGAGGCTGTGAGCTGCGGGTCAAGTTTTC<br>CAGATCTGCAGACGCCCCTGCTTACCAGCAGGGCCAGA<br>ACCAGCTGTATAACGAGCTGAATCTGGGGCGGAGAGAG<br>GAATACGACGTGCTGGATAAAAGGCGCGGGAGAGACCC<br>AGAAATGGGGGGAAAGCCACGACGGAAAAACCCCCAG<br>GAGGGACTGTACAATGAACTGCAGAAGGATAAAATGGC<br>AGAGGCCTATTCCGAAATCGGGATGAAGGGAGAAAGAA<br>GGCGAGGCAAAGGACACGACGGACTGTACCAGGGGCTG<br>TCTACCGCCACAAAGGACACCTATGATGCTCTGCATATG<br>CAGGCACTGCCACCCAGG |
| 594 | CD8α signal sequence, 6F8 scFv, CD8α hinge and transmembrane regions, 41BB cytoplasmic signaling domain, CD3ζ cytoplasmic signaling domain | ATGGCACTGCCAGTGACCGCCCTGCTGCTGCCTCTGGCC<br>CTGCTGCTGCACGCCGCCAGGCCTCAGGTGCAGCTGGTG<br>CAGTCTGGCGCCGAGGTGAAGAAGCCAGGCAGCTCCGT<br>GAAGGTGTCCTGCAAGGCCTCTGGCGGCACATTCACCAA<br>CTATTGTATCAGCTGGGTGAGACAGGCCCCAGGCCAGG<br>GACTGGAGTGGATGGGAGGAATCATCCCCATCTTCGGCA<br>CCACAAATTATGCCCAGACCTTTCAGGGCCGGGTGACAA<br>TCACCGCCGACAAGTCTACAAGCACCGCCTACATGGAGC<br>TGTCTAGCCTGAGATCCGAGGATACAGCCGTGTACTATT<br>GCGCCAGAGACAACGGCGATAGATACTATTACGACATG<br>GACGTGTGGGGCCAGGGCACCACAGTGACCGTGTCCTCT<br>GGAGGAGGAGGCAGCGGCGGAGGAGGCTCCGGAGGCG<br>GCGGCTCTGGCGGCGGCGGCTCCCAGTCTGTGCTGACAC<br>AGCCACCTAGCGTGTCCGCCGCCCCTGGCCAGAAGGTGA<br>CCATCTCTTGTAGCGGCAGCTCCTCTAATATCGGCAACA<br>ATTACGTGAGCTGGTACCAGCAGCTGCCAGGCACAGCCC<br>CCAAGCTGCTGATCTACGACAACAATAAGAGGCCTAGC |

TABLE 10-continued

Polynucleotide Sequences of exemplary DLL3 targeting CARs

| SEQ ID NO | CAR Structure | Nucleotide Sequence |
|---|---|---|
| | | GGCATCCCAGATCGCTTCTCCGGCTCTAAGAGCGGCACA<br>TCCGCCACCCTGGGCATCACAGGACTGCAGACCGGCGA<br>CGAGGCAGATTATTACTGCGGAACCTGGGACAGCTCCCT<br>GAGCGCCGTGGTGTTTGGAGGAGGCACAAAGCTGACCG<br>TGCTGACCACAACCCCTGCCCCTAGGCCACCTACCCCAG<br>CACCTACAATTGCTAGTCAGCCACTGTCACTGCGACCAG<br>AGGCATGTCGACCTGCAGCTGGAGGAGCAGTGCATACA<br>AGGGGACTGGACTTTGCCTGCGATATCTACATTTGGGCT<br>CCTCTGGCAGGAACATGTGGCGTGCTGCTGCTGAGCCTG<br>GTCATCACTCTGTACTGCAAGCGAGGCCGGAAGAAACT<br>GCTGTATATTTTCAAACAGCCCTTTATGCGACCTGTGCA<br>GACCACACAGGAGGAAGATGGGTGCTCCTGTCGGTTCCC<br>CGAGGAAGAGGAAGGAGGCTGTGAGCTGCGGGTCAAGT<br>TTTCCAGATCTGCAGACGCCCCTGCTTACCAGCAGGGCC<br>AGAACCAGCTGTATAACGAGCTGAATCTGGGGCGGAGA<br>GAGGAATACGACGTGCTGGATAAAAGGCGCGGGAGAGA<br>CCCAGAAATGGGGGAAAGCCACGACGGAAAAACCCCC<br>AGGAGGGACTGTACAATGAACTGCAGAAGGATAAAATG<br>GCAGAGGCCTATTCCGAAATCGGGATGAAGGGAGAAAG<br>AAGGCGAGGCAAAGGACACGACGGACTGTACCAGGGGC<br>TGTCTACCGCCACAAAGGACACCTATGATGCTCTGCATA<br>TGCAGGCACTGCCACCCAGG |
| 595 | CD8α signal sequence, 3G6-L1 scFv, CD8α hinge and transmembrane regions, 41BB cytoplasmic signaling domain, CD3ζ cytoplasmic signaling domain | ATGGCCCTGCCAGTGACCGCCCTGCTGCTGCCACTGGCC<br>CTGCTGCTGCACGCCGCCCGGCCACAGGTGCCCCTGGTG<br>CAGAGCGGAGCAGAGGTGAAGAAGCCCGGCAGCTCCGT<br>GAAGGTGAGCTGCAAGGCCTCCGGCGGCACATTCTCCAC<br>CTATTCTATCAGCTGGGTGCGGCAGGCCCCTGGCCAGGG<br>ACTGGAGTGGATGGGAGGAATCATCCCAATCTTCGGCAC<br>CACAAACTATGCCCAGAAGTTTCAGGGCAGGGTGACAA<br>TCACCGCCGACAAGTCCACATCTACCGCCTACATGGAGC<br>TGTCTAGCCTGAGGTCCGAGGACACAGCCGTGTACTATT<br>GTGCCCGCGATGGCGAGGGCTCTTACTATTACTATTACG<br>GAATGGACGTGTGGGGACAGGGAACCACAGTGACCGTG<br>TCCTCTGGCGGCGGCGGCTCTGGAGGAGGAGGCAGCGG<br>CGGAGGAGGCTCCGGAGGCGGCGGCAGCCAGTCCGTGC<br>TGACACAGCCACCTTCTGTGAGCGCCGCCCCTGGCCAGA<br>AGGTGACCATCTCCTGCTCTGGCAGCTCCTCTAATATCG<br>GCAACAATTATGTGAGCTGGTACCAGCAGCTGCCTGGCA<br>CAGCCCCAAAGCTGCTGATCTACGACAACAATAAGCGG<br>CCCTCCGGCATCCCTGATAGATTCTTTGGCTCTAAGTTCG<br>GCACAAGCGCCACCCTGGGCATCACAGGACTGCAGACC<br>GGCGACGAGGCAGATTATTACTGTGGAACCTGGGACAG<br>CTCCCTGAGCGCCGTGGTGTTTGGAGGAGGCACAAAGCT<br>GACCGTGCTGACCACAACCCCTGCCCCTAGGCCACCTAC<br>CCCAGCACCTACAATTGCTAGTCAGCCACTGTCACTGCG<br>ACCAGAGGCATGTCGACCTGCAGCTGGAGGAGCAGTGC<br>ATACAAGGGGACTGGACTTTGCCTGCGATATCTACATTT<br>GGGCTCCTCTGGCAGGAACATGTGGCGTGCTGCTGCTGA<br>GCCTGGTCATCACTCTGTACTGCAAGCGAGGCCGGAAGA<br>AACTGCTGTATATTTTCAAACAGCCCTTTATGCGACCTGT<br>GCAGACCACACAGGAGGAAGATGGGTGCTCCTGTCGGT<br>TCCCCGAGGAAGAGGAAGGAGGCTGTGAGCTGCGGGTC<br>AAGTTTTCCAGATCTGCAGACGCCCCTGCTTACCAGCAG<br>GGCCAGAACCAGCTGTATAACGAGCTGAATCTGGGGCG<br>GAGAGAGGAATACGACGTGCTGGATAAAAGGCGCGGGA<br>GAGACCCAGAAATGGGGGAAAGCCACGACGGAAAAA<br>CCCCCAGGAGGGACTGTACAATGAACTGCAGAAGGATA<br>AAATGGCAGAGGCCTATTCCGAAATCGGGATGAAGGGA<br>GAAAGAAGGCGAGGCAAAGGACACGACGGACTGTACCA<br>GGGGCTGTCTACCGCCACAAAGGACACCTATGATGCTCT<br>GCATATGCAGGCACTGCCACCCAGG |
| 596 | CD8α signal sequence, 4C6 scFv, CD8α hinge and transmembrane regions, 41BB cytoplasmic | ATGGCACTGCCAGTGACAGCCCTGCTGCTGCCTCTGGCC<br>CTGCTGCTGCACGCCGCCCGGCCACAGGTGCAGCTGCAG<br>GAGTCCGGCCCTGGCCTGGTGAAGCCATCTGAGACCCTG<br>AGCCTGACATGTACCGTGTCCGGCGATTCTATCAGCTCC<br>TACTATTGGTCTTGGATCAGGCAGCCCCCTGGCAAGGGA<br>CTGGAGTGGATCGGCTACATGTACTATAGCGGCATCACA<br>AACTATAATCCTAGCCTGAAGTCCCGCGTGAACATCTCC<br>CTGGACACCCTCTAAGAATCAGTTCAGCCTGAAGCTGGGC |

TABLE 10-continued

Polynucleotide Sequences of exemplary DLL3 targeting CARs

| SEQ ID NO | CAR Structure | Nucleotide Sequence |
|---|---|---|
| | signaling domain, CD3ζ cytoplasmic signaling domain | TCCGTGACAGCAGCAGATACCGCCGTGTACTATTGCGCA AGGCTGTCCGTGGCAGGCTTCTACTTTGACTATTGGGGC CAGGGCACACTGGTGACCGTGTCTAGCGGCGGCGGCGG CTCTGGAGGAGGAGGCAGCGGCGGAGGAGGCTCCGGCG GCGGCGGCTCTGAGATCGTGCTGACACAGAGCCCAGGC ACCCTGAGCCTGTCCCCCGGCGAGCGGGCCACACTGAGC TGTAGAGCCTCTCAGAGCGTGACCCGGTCCTACCTGGCC TGGTATCAGCAGAAGCCAGGCCAGGCCCCCAGACTGCT GATCTACGGCGCCTCCTCTAGGGCCACAGACATCCCAGA TCGCTTCTCCGGCTCTGGCAGCGGAACCGACTTTACACT GACCATCAACAGACTGGAGCCTGAGGATTTCGCCGTGTA CTATTGCCAGCAGTACGGCACAAGCCCACTGACCTTTGG CGGCGGCACCAAGGTGGAGATCAAGACCACAACCCCTG CCCCTAGGCCACCTACCCCAGCACCTACAATTGCTAGTC AGCCACTGTCACTGCGACCAGAGGCATGTCGACCTGCAG CTGGAGGAGCAGTGCATACAAGGGGACTGGACTTTGCC TGCGATATCTACATTTGGGCTCCTCTGGCAGGAACATGT GGCGTGCTGCTGCTGAGCCTGGTCATCACTCTGTACTGC AAGCGAGGCCGGAAGAAACTGCTGTATATTTTCAAACA GCCCTTTATGCGACCTGTGCAGACCACACAGGAGGAAG ATGGGTGCTCCTGTCGGTTCCCCGAGGAAGAGGAAGGA GGCTGTGAGCTGCGGGTCAAGTTTTCCAGATCTGCAGAC GCCCCTGCTTACCAGCAGGGCCAGAACCAGCTGTATAAC GAGCTGAATCTGGGGCGGAGAGAGGAATACGACGTGCT GGATAAAAGGCGCGGGAGAGACCCAGAAATGGGGGGA AAGCCACGACGGAAAAACCCCCAGGAGGGACTGTACAA TGAACTGCAGAAGGATAAAATGGCAGAGGCCTATTCCG AAATCGGGATGAAGGGAGAAAGAAGGCGAGGCAAAGG ACACGACGGACTGTACCAGGGGCTGTCTACCGCCACAA AGGACACCTATGATGCTCTGCATATGCAGGCACTGCCAC CCAGG |
| 597 | CD8α signal sequence, 4E6 scFv, CD8α hinge and transmembrane regions, 41BB cytoplasmic signaling domain, CD3ζ cytoplasmic signaling domain | ATGGCACTGCCAGTGACAGCCCTGCTGCTGCCTCTGGCC CTGCTGCTGCACGCCGCCCGGCCACAGGTGCAGCTGCAG GAGAGCGGCCCTGGCCTGGTGAAGCCATCTGAGACCCT GAGCCTGACATGTACCGTGAGCTCCGATTCCATCTCTAG CTACTATTGGTCTTGGATCAGACAGCCCCCTGGCAAGGG CCTGGAGTGGATCTCCTACATCTACTATTCCGGCATCTCT AACTATAATCCTAGCCTGAAGAGCCGGGTGAGCATCTCT GTGGACACCTCCAAGAACCAGTTTTCTCTGAGACTGTCC TCTGTGACAGCCGCCGATACCGCCGTGTACTATTGCGCC AGAATCAGCGTGGCCGGCTTCTTTTTCGACAATTGGGGC CAGGGCACACTGGTGACCGTGAGCTCCGGAGGAGGAGG CAGCGGAGGAGGAGGCTCCGGAGGCGGCGGCTCTGGCG GCGGCGGCAGCGAGATCATGCTGACACAGAGCCCAGAT ACCCTGAGCCTGTCCCCCGGCGAAAGGGCCACACTGTCC TGTAGAGCCTCTCAGAGCGTGTCTAGCTCCTACCTGGCC TGGTATCAGCAGAAGCCAGGCCAGGCACCCAGGCTGCT GATCTACGGAGCATCTAGCAGGGCCGCAGGAGTGCCAG ACCGCTTTTCCGGCTCTGGCAGCGGCACCGATTTCACAC TGACCATCTCTCGCCTGGCCCCTGAGGACTTTGTGGTGT ACTATTGCCAGCAGTATGGCATCTCCCCACTGACATTCG GCGGCGGCACCAAGGTGGAGATCAAGACCACAACCCCT GCCCCTAGGCCACCTACCCCAGCACCTACAATTGCTAGT CAGCCACTGTCACTGCGACCAGAGGCATGTCGACCTGCA GCTGGAGGAGCAGTGCATACAAGGGGACTGGACTTTGC CTGCGATATCTACATTTGGGCTCCTCTGGCAGGAACATG TGGCGTGCTGCTGCTGAGCCTGGTCATCACTCTGTACTG CAAGCGAGGCCGGAAGAAACTGCTGTATATTTTCAAAC AGCCCTTTATGCGACCTGTGCAGACCACACAGGAGGAA GATGGGTGCTCCTGTCGGTTCCCCGAGGAAGAGGAAGG AGGCTGTGAGCTGCGGGTCAAGTTTTCCAGATCTGCAGA CGCCCCTGCTTACCAGCAGGGCCAGAACCAGCTGTATAA CGAGCTGAATCTGGGGCGGAGAGAGGAATACGACGTGC TGGATAAAAGGCGCGGGAGAGACCCAGAAATGGGGGG AAAGCCACGACGGAAAAACCCCCAGGAGGGACTGTACA ATGAACTGCAGAAGGATAAAATGGCAGAGGCCTATTCC GAAATCGGGATGAAGGGAGAAAGAAGGCGAGGCAAAG GACACGACGGACTGTACCAGGGGCTGTCTACCGCCACA AAGGACACCTATGATGCTCTGCATATGCAGGCACTGCCA CCCAGG |

TABLE 10-continued

Polynucleotide Sequences of exemplary DLL3 targeting CARs

| SEQ ID NO | CAR Structure | Nucleotide Sequence |
|---|---|---|
| 598 | CD8α signal sequence, 4H8 scFv, CD8α hinge and transmembrane regions, 41BB cytoplasmic signaling domain, CD3ζ cytoplasmic signaling domain | ATGGCTCTGCCTGTCACCGCTCTGCTGCTGCCTCTGGCTC TGCTGCTGCACGCGGCGCGCCCGCAGGTGCAGCTGCAGC AGAGCGGCCCTGGCCTGGTGAAGCCTAGCCAGACACTG TCCCTGACCTGTGCCATCTCTGGCGACAGCGTGAGCTCC AACAGCGCCACATGGAATTGGATCAGGCAGTCCCCATCT CGCGGCCTGGAGTGGCTGGGACGGACCTACTATAGATCC AAGTGGTACGACGATTATGCCGTGTCCGTGAAGTCTCGC ATCACAATCAACCCTGACACCTCCAAGAATCACCTGTCT CTGCACCTGAACAGCGTGACACCAGAGGATACCGCCGT GTACTATTGCGCAGGAGGAGGACTGGTGGGCGCCCCTG ACGGATTCGACGTGTGGGGCCAGGGCACAATGGTGACC GTGTCTAGCGGCGGCGGCGGCTCTGGAGGAGGAGGCAG CGGCGGAGGAGGCTCCGGAGGCGGCGGCTCTCAGTCCG TGCTGACACAGCCCCCTTCTGCCAGCGGAACACCCGGCC AGCGGGTGACCATCTCCTGTTCTGGCTCCTCTAGCAACA TCGGCTCCGACCCTGTGAATTGGTACCAGCAGCTGCCAG GCACAGCCCCCAAGCTGCTGATCTATAGCAACAATCAGC GGCCTTCCGGCGTGCCAGATAGATTCAGCGGCTCCAAGT CTGGCACCAGCGCCTCCCTGGCAATCTCTGGACTGCAGA GCGAGGACGAGGCCGATTACTATTGCTCCGCCTGGGACG ATTCTCTGAATGGCTACGTGTTTGGCACAGGCACCAAGG TGACCGTGCTGACCACAACCCCAGCACCTAGGCCACCTA CACCTGCACCAACCATCGCCAGCCAGCCTCTGTCCCTGA GACCAGAGGCCTGTAGGCCAGCAGCAGGAGGAGCAGTG CACACCCGGGGCCTGGACTTCGCCTGCGATATCTACATC TGGGCACCACTGGCAGGAACATGTGGCGTGCTGCTGCTG TCCCTGGTCATCACCCTGTACTGCAAGAGAGGCAGGAAG AAGCTGCTGTATATCTTCAAGCAGCCCTTCATGAGACCC GTGCAGACAACCCAGGAGGAGGACGGCTGCAGCTGTAG GTTCCCAGAGGAGGAGGAGGGAGGATGTGAGCTGCGCG TGAAGTTTTCCCGGTCTGCCGATGCACCTGCATACCAGC AGGGACAGAACCAGCTGTATAACGAGCTGAATCTGGGC CGGAGAGAGGAGTACGACGTGCTGGATAAGAGGAGGGG AAGGGACCCTGAGATGGGAGGCAAGCCTCGGAGAAAGA ACCCACAGGAGGGCCTGTACAATGAGCTGCAGAAGGAC AAGATGGCCGAGGCCTATAGCGAGATCGGCATGAAGGG AGAGAGGCGCCGGGGCAAGGGACACGATGGCCTGTATC AGGGCCTGTCAACCGCTACAAAAGATACCTACGATGCTC TGCACATGCAGGCTCTGCCACCAAGA |
| 599 | CD8α signal sequence, 9H12-K scFv, CD8α hinge and transmembrane regions, 41BB cytoplasmic signaling domain, CD3ζ cytoplasmic signaling domain | ATGGCTCTGCCTGTCACCGCTCTGCTGCTGCCTCTGGCTC TGCTGCTGCACGCGGCGCGCCCGCAGGTGCAGCTGGTGC AGAGCGGAGCAGAGGTGAAGAAGCCTGGCGCCAGCGTG AAGGTGTCCTGCAAGGCCTCTGGCTACACATTCACCGGC TATTCTATCCACTGGGTGCGCCAGGCCCCTGGCCAGGGA CTGGAGTGGATGGGCTGGATCAACCCAAATAGCGGCGG CACCTTCTACGCCCAGAAGTTTCAGGGCAGGGTGACAAT GACCCGCGACACATCTATCAGCACCGTGTATATGGAGCT GAGCCGGCTGAGATCCGACGATACAGCCGTGTACTATTG TGCCAGAGACGGCTGGGGCGATTACTATTACTATGGACT GGACGTGTGGGGACAGGGAACCACAGTGACCGTGTCCC TGGGCGGCGGCGGCTCTGGAGGAGGAGGCAGCGGCGGA GGAGGCTCCGGAGGCGGCGGCTCTGATATCCAGATGAC ACAGAGCCCTAGCTCCGTGTCCGCCTCTGTGGGCGACAG GGTGACAATCACCTGCAGAGCCTCCCAGGATATCTCTAG CTGGCTGGCCTGGTACCAGCAGAAGCCCGGCAAGGCCC CTAAGCTGCTGATCTATACCGCATCCTCTCTGCAGGGAG GAGTGCCATCCCGGTTCAGCGGCTCCGGCTCTGGAACAG ACTTTACACTGACCATCAGCTCCCTGCAGCCAGAGGATC TGGCCACCTACTTCTTGTCAGCAGGCCAACGTGTTCCCCT ATACATTTGGCCAGGGCACCAAGCTGGAGATCAAGACC ACAACCCCAGCACCTAGGCCACCTACACCTGCACCAACC ATCGCCAGCCAGCCTCTGTCCCTGAGACCAGAGGCCTGT AGGCCAGCAGCAGGAGGAGCAGTGCACACCCGGGGCCT GGACTTCGCCTGCGATATCTACATCTGGGCACCACTGGC AGGAACATGTGGCGTGCTGCTGCTGTCCCTGGTCATCAC CCTGTACTGCAAGAGAGGCAGGAAGAAGCTGCTGTATA TCTTCAAGCAGCCCTTCATGAGACCCGTGCAGACAACCC AGGAGGAGGACGGCTGCAGCTGTAGGTTCCCAGAGGAG GAGGAGGAGGATGTGAGCTGCGCGTGAAGTTTTCCCG GTCTGCCGATGCACCTGCATACCAGCAGGGACAGAACC AGCTGTATAACGAGCTGAATCTGGGCCGGAGAGAGGAG TACGACGTGCTGGATAAGAGGAGGGGAAGGGACCCTGA |

TABLE 10-continued

Polynucleotide Sequences of exemplary DLL3 targeting CARs

| SEQ ID NO | CAR Structure | Nucleotide Sequence |
|---|---|---|
| | | GATGGGAGGCAAGCCTCGGAGAAAGAACCCACAGGAGG GCCTGTACAATGAGCTGCAGAAGGACAAGATGGCCGAG GCCTATAGCGAGATCGGCATGAAGGGAGAGAGGCGCCG GGGCAAGGGACACGATGGCCTGTATCAGGGCCTGTCAA CCGCTACAAAAGATACCTACGATGCTCTGCACATGCAGG CTCTGCCACCAAGA |
| 600 | CD8α signal sequence, 10G1-K scFv, CD8α hinge and transmembrane regions, 41BB cytoplasmic signaling domain, CD3ζ cytoplasmic signaling domain | ATGGCTCTGCCTGTCACCGCTCTGCTGCTGCCTCTGGCTC TGCTGCTGCACGCGGCGCGCCCGGAGGTGCAGCTGCTGG AGTCCGGCGGCGGCCTGGTGCAGCCAGGCGGCTCTCTGA GGCTGAGCTGCGCAGCATCCGGCTTCACCTTTAGCTCCT ACGCAATGAACTGGGTGCGCCAGGCCCCCGGCAAGGGA CTGGAGTGGGTGTCTACAATCTCTGGCAGCGGCGGCAGC ACCTACTATGCCGACTCCGTGAAGGGCCGGTTCACAATC TCTAGAGATAACAGCAAGAATACCCTGTACCTGCAGATG AACAGCCTGCGGGCCGAGGACACAGCCGTGTTTATTGT GCCATCGACCCAGAGTACTATGATATCCTGACCGGCGGC GATTATTGGGGCCAGGGCACACTGGTGACCGTGTCTAGC GGCGGCGGCGGCTCTGGAGGAGGAGGCAGCGGCGGAGG AGGCTCCGGAGGCGGCGGCTCTGACATCCAGATGACCC AGTCCCCATCTGCCATGAGCGCCTCCGTGGGCGATAGGG TGACAATCACCTGCCGCGCCTCCCAGGGCATCTCTAACT ACCTGGCCTGGTTCCAGCAGAAGCCCGGCAAGGTGCCTA AGCGGCTGATCTATGCAGCATCCTCTCTGCAGAGCGGAG TGCCTTCCAGATTCTCTGGCAGCGGCTCCGGCACAGAGT TTACACTGACCATCAGCTCCCTGCAGCCCGAGGACTTCG CCACCTACTTTTGTCTGCAGCACGATTCCTTCCCTCTGAC ATTTGGCGGCGGCACCAAGGTGGAGATCAAGACCACAA CCCCAGCACCTAGGCCACCTACACCTGCACCAACCATCG CCAGCCAGCCTCTGTCCCTGAGACCAGAGGCCTGTAGGC CAGCAGCAGGAGGAGCAGTGCACACCCGGGGCCTGGAC TTCGCCTGCGATATCTACATCTGGGCACCACTGGCAGGA ACATGTGGCGTGCTGCTGCTGTCCCTGGTCATCACCCTG TACTGCAAGAGAGGCAGGAAGAAGCTGCTGTATATCTTC AAGCAGCCCTTCATGAGACCCGTGCAGACAACCCAGGA GGAGGACGGCTGCAGCTGTAGGTTCCCAGAGGAGGAGG AGGGAGGATGTGAGCTGCGCGTGAAGTTTTCCCGGTCTG CCGATGCACCTGCATACCAGCAGGGACAGAACCAGCTG TATAACGAGCTGAATCTGGGCCGGAGAGAGGAGTACGA CGTGCTGGATAAGAGGAGGGGAAGGGACCCTGAGATGG GAGGCAAGCCTCGGAGAAAGAACCCACAGGAGGGCCTG TACAATGAGCTGCAGAAGGACAAGATGGCCGAGGCCTA TAGCGAGATCGGCATGAAGGGAGAGAGGCGCCGGGGCA AGGGACACGATGGCCTGTATCAGGGCCTGTCAACCGCTA CAAAAGATACCTACGATGCTCTGCACATGCAGGCTCTGC CACCAAGA |
| 601 | CD8α signal sequence, 11A3 scFv, CD8α hinge and transmembrane regions, 41BB cytoplasmic signaling domain, CD3ζ cytoplasmic signaling domain | ATGGCTCTGCCTGTCACCGCTCTGCTGCTGCCTCTGGCTC TGCTGCTGCACGCGGCGCGCCCGCAGGTGCAGCTGCAG GAGTCCGGCCCTGGCCTGGTGAAGCCAAGCGAGACCCT GTCCCTGACATGTACCGTGAGCTCCGATTCTATCAGCAA CTACTATTGGAGCTGGATCAGGCAGCCCCCTGGCAAGGG ACTGGAGTGGATCTCCTACATCTACTATTCTGGCATCAC CAACTATAATCCTTCCCTGAAGTCTCGCGTGACAATCTC TGTGGACACCAGCAAGAATCAGTTCAGCCTGAAGCTGTC TAGCGTGACAGCCGCCGATACCGCCGTGTACTATTGCGC CCGGATCACAGTGACCGGCTTCTACTTTGACTATTGGGG CCAGGGCACACTGGTGACCGTGTCCTCTGGCGGCGGCGG CTCTGGAGGAGGAGGCAGCGGCGGAGGAGGCTCCGGAG GCGGCGGCTCTGAGATCGTGCTGACACAGTCCCCAGGCA CCCTGTCCCTGTCTCCCGGCGAGCGGGCCACACTGTCTT GTAGAGCCAGCCAGTCCATCTCTCGGAGCTACCTGGCCT GGTATCAGCAGAAGCCAGGCCAGGCCCCCAGACACCTG ATCTACGGAGCAAGCTCCAGGGCCACCGGCATCCCCGA CCGCTTCTCCGGCTCTGGCAGCGGCACAGACTTCATCCT GACCATCTCCAGACTGGAGCCTGAGGACTTCGCCGTGTA CTATTGCCAGCAGTACGATACAAGCCCACTGACCTTTGG CGGCGGCACCAAGGTGGAGATCAAGACCACAACCCCAG CACCTAGGCCACCTACACCTGCACCAACCATCGCCAGCC AGCCTCTGTCCCTGAGACCAGAGGCCTGTAGGCCAGCAG CAGGAGGAGCAGTGCACACCCGGGGCCTGGACTTCGCC TGCGATATCTACATCTGGGCACCACTGGCAGGAACATGT GGCGTGCTGCTGCTGTCCCTGGTCATCACCCTGTACTGC AAGAGAGGCAGGAAGAAGCTGCTGTATATCTTCAAGCA |

TABLE 10-continued

Polynucleotide Sequences of exemplary DLL3 targeting CARs

| SEQ ID NO | CAR Structure | Nucleotide Sequence |
|---|---|---|
| | | GCCCTTCATGAGACCCGTGCAGACAACCCAGGAGGAGG ACGGCTGCAGCTGTAGGTTCCCAGAGGAGGAGGAGGGA GGATGTGAGCTGCGCGTGAAGTTTTCCCGGTCTGCCGAT GCACCTGCATACCAGCAGGGACAGAACCAGCTGTATAA CGAGCTGAATCTGGGCCGGAGAGAGGAGTACGACGTGC TGGATAAGAGGAGGGGAAGGGACCCTGAGATGGGAGGC AAGCCTCGGAGAAAGAACCCACAGGAGGGCCTGTACAA TGAGCTGCAGAAGGACAAGATGGCCGAGGCCTATAGCG AGATCGGCATGAAGGGAGAGAGGCGCCGGGGCAAGGG ACACGATGGCCTGTATCAGGGCCTGTCAACCGCTACAAA AGATACCTACGATGCTCTGCACATGCAGGCTCTGCCACC AAGA |
| 602 | CD8α signal sequence, 3B11 scFv, CD8α hinge and transmembrane regions, 41BB cytoplasmic signaling domain, CD3ζ cytoplasmic signaling domain | ATGGCACTGCCAGTGACAGCCCTGCTGCTGCCACTGGCC CTGCTGCTGCACGCCGCCCGGCCACAGGTGCAGCTGCAG CAGAGCGGCCCTGGCCTGGTGAAGCCTAGCCAGACACT GTCCCTGACCTGTGCCATCTCTGGCGACAGCGTGAGCTC CAACAGCGTGGTGTGGAATTGGATCAGGCAGTCCCCATC TCGCGGCCTGGAGTGGCTGGGACGGACCTACTATAGATC CAAGTGGTACGACGATTATGCCGTGTCCGTGAAGTCTAG GATCACAATCAACCCTGACACCAGCAAGAATCAGTTCTC CCTGCAGCTGAACTCTGTGACACCAGAGGATACCGCCGT GTACCACTGCGCCAGAGGCGGAATCGTGGGCGCCCCTG ACGCCTTTGATATCTGGGGCCAGGGCACAATGGTGACCG TGTCTAGCGGAGGAGGAGGCAGCGGAGGAGGAGGCTCC GGAGGCGGCGGCTCTGGCGGCGGCGGCAGCCAGTCCGT GCTGACCCAGCCACCTTCTGCCAGCGGAACACCCGGCCA GCGGGTGACCATCTCCTGTTCTGGCTCCTCTAGCAACAT CGGCTCTGACCCTGTGAGCTGGTACCAGCAGTTCCCAGG CACAGCCCCCAAGCTGCTGATCTATACCAACAATCAGCG GCCTAGCGGCGTGCCAGATCGGTTCAGCGGCTCCAAGTC TGGCACAAGCGCCTCCCTGGCAATCTCCGGACTGCAGTC TGAGGACGAGGCCGATTACTATTGCGCCGCCTGGGACG ATTCCCTGAATGGCCACGTGTTCGGCACAGGCACCAAGG TGACCGTGCTGACCACAACCCCCGCCCCTAGGCCACCTA CCCCAGCACCTACAATTGCTAGTCAGCCACTGTCACTGC GACCAGAGGCATGTCGACCTGCAGCTGGAGGAGCAGTG CATACAAGGGGACTGGACTTTGCCTGCGATATCTACATT TGGGCTCCTCTGGCAGGAACATGTGGCGTGCTGCTGCTG AGCCTGGTCATCACTCTGTACTGCAAGCGAGGCCGGAAG AAACTGCTGTATATTTTCAAACAGCCCTTTATGCGACCT GTGCAGACCACACAGGAGGAAGATGGGTGCTCCTGTCG GTTCCCCGAGGAAGAGGAAGGAGGCTGTGAGCTGCGGG TCAAGTTTTCCAGATCTGCAGACGCCCCTGCTTACCAGC AGGGCCAGAACCAGCTGTATAACGAGCTGAATCTGGGG CGGAGAGAGGAATACGACGTGCTGGATAAAAGGCGCGG GAGAGACCCAGAAATGGGGGAAAGCCACGACGGAAA AACCCCCAGGAGGGACTGTACAATGAACTGCAGAAGGA TAAAATGGCAGAGGCCTATTCCGAAATCGGGATGAAGG GAGAAAGAAGGCGAGGCAAAGGACACGACGGACTGTA CCAGGGGCTGTCTACCGCCACAAAGGACACCTATGATGC TCTGCATATGCAGGCACTGCCACCCAGG |
| 603 | CD8α signal sequence, 5G2 scFv, CD8α hinge and transmembrane regions, 41BB cytoplasmic signaling domain, CD3ζ cytoplasmic signaling domain | ATGGCCCTGCCAGTGACCGCCCTGCTGCTGCCACTGGCC CTGCTGCTGCACGCCGCCCGGCCACAGGTGCAGCTGCAG CAGTCCGGCCCTGGCCTGGTGAAGCCTTCTCAGACACTG AGCCTGACCTGTGCCATCTCCGGCGACTCTGTGAGCTCC AACTCTGCCGTGTGGAATTGGATCAGACAGTCCCCCTCT AGAGGCCTGGAGTGGCTGGGCTGGACATACTATCGGAG CAAGTACTATAACGACTACGCCGTGAGCCTGAAGTCCAG AATCACAATCAACCCTGATACCAGCAAGAATCAGTTCTC CCTGCAGCTGAACAGCCTGACACCAGAGGATACCGCCG TGTACTATTGCACCAGGGGCGGAATCGTGGGCGCCCCTG ACGGCTTTGATATCTGGGGCCAGGGCACAATGGTGACCG TGTCTAGCGGAGGAGGAGGCAGCGGAGGAGGAGGCTCC GGAGGCGGCGGCTCTGGCGGCGGCGGCAGCCAGTCCGC CCTGACACAGCCACCTTCTGCCAGCGGAACACCCGGCCA GCGCGTGACCATCTCCTGTTCTGGCAGCAACTCCAATAT CGGCTCCAACCCTATCAATTGGTACCAGCAGCTGCCAGG CACAGCCCCCAAGCTGCTGATCTATAGCAACAATCAGAG GCCTTCCGGCGTGCCAGACCGCTTCTCTGGCAGCAAGTC CGGCACCTCTGCCAGCCTGGCAATCTCCGGACTGCAGTC TGAGGACGAGGCCGATTACTATTGCGCAGCATGGGACG ATAGCCTGAACGGACACGTGTTTGGCACAGGCACCAAG |

TABLE 10-continued

Polynucleotide Sequences of exemplary DLL3 targeting CARs

| SEQ ID NO | CAR Structure | Nucleotide Sequence |
|---|---|---|
| | | GTGACCGTGCTGACCACAACCCCCGCCCCTAGGCCACCT<br>ACCCCAGCACCTACAATTGCTAGTCAGCCACTGTCACTG<br>CGACCAGAGGCATGTCGACCTGCAGCTGGAGGAGCAGT<br>GCATACAAGGGGACTGGACTTTGCCTGCGATATCTACAT<br>TTGGGCTCCTCTGGCAGGAACATGTGGCGTGCTGCTGCT<br>GAGCCTGGTCATCACTCTGTACTGCAAGCGAGGCCGGAA<br>GAAACTGCTGTATATTTTCAAACAGCCCTTTATGCGACC<br>TGTGCAGACCACACAGGAGGAAGATGGGTGCTCCTGTC<br>GGTTCCCCGAGGAAGAGGAAGGAGGCTGTGAGCTGCGG<br>GTCAAGTTTTCCAGATCTGCAGACGCCCCTGCTTACCAG<br>CAGGGCCAGAACCAGCTGTATAACGAGCTGAATCTGGG<br>GCGGAGAGAGGAATACGACGTGCTGGATAAAAGGCGCG<br>GGAGAGACCCAGAAATGGGGGAAAGCCACGACGGAA<br>AAACCCCCAGGAGGGACTGTACAATGAACTGCAGAAGG<br>ATAAAATGGCAGAGGCCTATTCCGAAATCGGGATGAAG<br>GGAGAAAGAAGGCGAGGCAAAGGACACGACGGACTGT<br>ACCAGGGGCTGTCTACCGCCACAAAGGACACCTATGAT<br>GCTCTGCATATGCAGGCACTGCCACCCAGG |
| 604 | CD8α signal sequence, 11E4 scFv, CD8α hinge and transmembrane regions, 41BB cytoplasmic signaling domain, CD3ζ cytoplasmic signaling domain | ATGGCACTGCCTGTGACAGCCCTGCTGCTGCCACTGGCC<br>CTGCTGCTGCACGCCGCCCGGCCCCAGGTGCAGCTGCAG<br>GAGAGCGGCCCAGGCCTGGTGAAGCCAAGCGAGACCCT<br>GTCCCTGACATGTACCGTGTCTGGCGGCAGCATCAGCTC<br>CTACTATTGGTCCTGGATCAGACAGTCTCCTGGCAAGGG<br>CCTGGAGTGGATCGGCTACGTGTACTATTCCGACATCAC<br>CAACTATAATCCATCCCTGAAGTCTAGAGTGACAATCTC<br>TGTGGATACCAGCAAGAACCAGTTCAGCCTGAACCTGA<br>ACAGCGTGACAGCCGCCGACACCGCCTTCTACTTTTGCG<br>CCAGGATCGGCGTGGCCGGCTTCTACTTTGATTATTGGG<br>GCCAGGGCACACTGGTGACCGTGTCTAGCGGCGGCGGC<br>GGCTCTGGAGGAGGAGGCAGCGGCGGAGGAGGCTCCGG<br>CGGCGGCGGCTCTGAGATCGTGCTGACACAGAGCCCAG<br>ACACCCTGAGCCTGTCCCCTGGCGAGAGGGCCACACTGT<br>CCTGTAGGGCATCTCAGAGCGTGTCCCGGAGATACCTGG<br>CCTGGTATCAGCAGAAGCCTGGCCAGGCACCTCGCCTGC<br>TGATCTACGGAGCATCCTCTCGGGCCACAGGCATCCCCG<br>ACAGATTCTCTGGCAGCGGCTCCGGAACCGACTTCACCC<br>TGACCATCTCTAGGCTGGAGCCAGAGGATTTCGAGGTGT<br>ACTATTGCCAGCAGTATGGCACATCCCCAATCACCTTTG<br>GCCAGGGAACCCGCCTGGAGATCAAGACCACAACCCCT<br>GCCCCTAGGCCACCTACCCCAGCACCTACAATTGCTAGT<br>CAGCCACTGTCACTGCGACCAGAGGCATGTCGACCTGCA<br>GCTGGAGGAGCAGTGCATACAAGGGGACTGGACTTTGC<br>CTGCGATATCTACATTTGGGCTCCTCTGGCAGGAACATG<br>TGGCGTGCTGCTGCTGAGCCTGGTCATCACTCTGTACTG<br>CAAGCGAGGCCGGAAGAAACTGCTGTATATTTTCAAAC<br>AGCCCTTTATGCGACCTGTGCAGACCACACAGGAGGAA<br>GATGGGTGCTCCTGTCGGTTCCCCGAGGAAGAGGAAGG<br>AGGCTGTGAGCTGCGGGTCAAGTTTTCCAGATCTGCAGA<br>CGCCCCTGCTTACCAGCAGGGCCAGAACCAGCTGTATAA<br>CGAGCTGAATCTGGGGCGGAGAGAGGAATACGACGTGC<br>TGGATAAAAGGCGCGGGAGAGACCCAGAAATGGGGGG<br>AAAGCCACGACGGAAAAACCCCCAGGAGGGACTGTACA<br>ATGAACTGCAGAAGGATAAAATGGCAGAGGCCTATTCC<br>GAAATCGGGATGAAGGGAGAAAGAAGGCGAGGCAAAG<br>GACACGACGGACTGTACCAGGGGCTGTCTACCGCCACA<br>AAGGACACCTATGATGCTCTGCATATGCAGGCACTGCCA<br>CCCAGG |
| 605 | CD8α signal sequence, 2404.8E11 scFv, CD8α hinge and transmembrane regions, 41BB cytoplasmic signaling domain, CD3ζ | ATGGCCCTGCCAGTGACCGCCCTGCTGCTGCCACTGGCC<br>CTGCTGCTGCACGCCGCCCGGCCACAGATCCAGCTGCAG<br>CAGTCCGGCCCTGGCCTGGTGAAGCCTAGCCAGACACTG<br>TCCCTGACCTGCGCCATCTCTGGCGACAGCGTGAGCTCC<br>AACTCTGCCGTGTGGAATTGGATCAGGCAGTCCCCATCT<br>CGCGGCCTGGAGTGGCTGGGAAGGACATACTATAGAAG<br>CAAGTGGTACAACGACTATGCCGTGTCCGTGAAGTCTAG<br>GATCACAATCAAGCCTGATACCGCCAAGAACCAGTTCTC<br>CCTGCAGCTGAACAGCGTGACACCAGAGGATACCGCCG<br>TGTACTATTTCACCCGCGGCGGAATCGTGGGCGCCCCTG<br>ACGCCTTTGATATCTGGGGCCAGGGCACAATGGTGACCG |

TABLE 10-continued

Polynucleotide Sequences of exemplary DLL3 targeting CARs

| SEQ ID NO | CAR Structure | Nucleotide Sequence |
|---|---|---|
| | cytoplasmic signaling domain | TGTCTAGCGGAGGAGGAGGCAGCGGAGGAGGAGGCTCC GGAGGCGGCGGCTCTGGCGGCGGCGGCAGCCAGTCCGT GCTGACACAGCCCCCTTCTGCCAGCGGAACACCCGGCCA GCGGGTGACCATCTCCTGCTCTGGCTCCTCTAGCAACAT CGGCTCCGACCCTATCAATTGGTACCAGCAGGTGCCAGG CACAGCCCCCAAGCTGCTGATCTATAGCAACAATCAGCG GCCTTCCGGCGTGCCAGATAGATTCAGCGGCTCCAAGTC TGGCACCAGCGCCTCCCTGGCAATCTCTGGACTGCAGAG CGAGGACGAGGCCGATTACTATTGTGCCGCCTGGGACG ATAGCCTGAATGGCTACGTGTTTGGCACAGGCACCAAGG TGACCGTGCTGACCACAACCCCCGCCCCTAGGCCACCTA CCCCAGCACCTACAATTGCTAGTCAGCCACTGTCACTGC GACCAGAGGCATGTCGACCTGCAGCTGGAGGAGCAGTG CATACAAGGGGACTGGACTTTGCCTGCGATATCTACATT TGGGCTCCTCTGGCAGGAACATGTGGCGTGCTGCTGCTG AGCCTGGTCATCACTCTGTACTGCAAGCGAGGCCGGAAG AAACTGCTGTATATTTTCAAACAGCCCTTTATGCGACCT GTGCAGACCACACAGGAGGAAGATGGGTGCTCCTGTCG GTTCCCCGAGGAAGAGGAAGGAGGCTGTGAGCTGCGGG TCAAGTTTTCCAGATCTGCAGACGCCCCTGCTTACCAGC AGGGCCAGAACCAGCTGTATAACGAGCTGAATCTGGGG CGGAGAGAGGAATACGACGTGCTGGATAAAAGGCGCGG GAGAGACCCAGAAATGGGGGAAAGCCACGACGGAAA AACCCCCAGGAGGGACTGTACAATGAACTGCAGAAGGA TAAAATGGCAGAGGCCTATTCCGAAATCGGGATGAAGG GAGAAAGAAGGCGAGGCAAAGGACACGACGGACTGTA CCAGGGGCTGTCTACCGCCACAAAGGACACCTATGATGC TCTGCATATGCAGGCACTGCCACCCAGG |
| 606 | CD8α signal sequence, 10A2 scFv, CD8α hinge and transmembrane regions, 41BB cytoplasmic signaling domain, CD3ζ cytoplasmic signaling domain | ATGGCCCTGCCAGTGACCGCCCTGCTGCTGCCACTGGCC CTGCTGCTGCACGCCGCCCGGCCACAGGTGCAGCTGCAG CAGAGCGGCCCTGGCCTGGTGAAGCCTAGCGAGACACT GTCCCTGACCTGTGCCATCTCTGGCGACAGCGTGAGCTC CAACAGCGCCACATGGAATTGGATCAGGCAGTCCCCATC TCGCGGCCTGGAGTGGCTGGGACGGACCTACTATAGATC CGAGTGGTACAACGACTATGCCGTGTCCGTGAAGTCTCG GATCACAATCAACCCTGATACCTCCAAGAATCACCTGTC TCTGCACCTGAATAGCGTGACACCAGAGGATACCGCCGT GTACTATTGCGCAGGAGGAGGAATCGTGGGCGCCCCTG ACGGATTCGACGTGTGGGGCCAGGGCACAATGGTGACC GTGTCTAGCGGAGGAGGAGGCTCCGGAGGAGGAGGCTC TGGCGGCGGCGGCAGCGAGGCGGCGGCAGCCAGTCCG TGCTGACACAGCCACCTTCTGCCAGCGGAACACCCGGCC AGAGGGTGACCATCTCCTGTTCTGGCTCCTCTAGCAACA TCGGCAGCGACCCTGTGATCTGGTACCAGCAGCTGCCAC GCACAGCCCCCAAGCTGCTGATCTATTCCAACAATCAGC GGCCTTCTGGCGTGCCAGATAGATTCAGCGGCTCCAAGT CTGGCACCAGCGCCTCCCTGGCAATCTCTGGACTGCAGA GCGAGGACGAGGCCGATTACTATTGCGCCGCCTGGGAC GATTCCCTGAATGGCTACGTGTTTGGCACAGGCACCAAG GTGACCGTGCTGACCACAACCCCCGCCCCTAGGCCACCT ACCCCAGCACCTACAATTGCTAGTCAGCCACTGTCACTG CGACCAGAGGCATGTCGACCTGCAGCTGGAGGAGCAGT GCATACAAGGGGACTGGACTTTGCCTGCGATATCTACAT TTGGGCTCCTCTGGCAGGAACATGTGGCGTGCTGCTGCT GAGCCTGGTCATCACTCTGTACTGCAAGCGAGGCCGGAA GAAACTGCTGTATATTTTCAAACAGCCCTTTATGCGACC TGTGCAGACCACACAGGAGGAAGATGGGTGCTCCTGTC GGTTCCCCGAGGAAGAGGAAGGAGGCTGTGAGCTGCGG GTCAAGTTTTCCAGATCTGCAGACGCCCCTGCTTACCAG CAGGGCCAGAACCAGCTGTATAACGAGCTGAATCTGGG GCGGAGAGAGGAATACGACGTGCTGGATAAAAGGCGCG GGAGAGACCCAGAAATGGGGGAAAGCCACGACGGAA AACCCCCAGGAGGGACTGTACAATGAACTGCAGAAGG ATAAAATGGCAGAGGCCTATTCCGAAATCGGGATGAAG GGAGAAAGAAGGCGAGGCAAAGGACACGACGGACTGT ACCAGGGGCTGTCTACCGCCACAAAGGACACCTATGAT GCTCTGCATATGCAGGCACTGCCACCCAGG |
| 607 | CD8α signal sequence, 11A8 scFv, CD8α hinge and | ATGGCACTGCCAGTGACAGCCCTGCTGCTGCCACTGGCC CTGCTGCTGCACGCCGCCCGGCCACAGGTGCAGCTGCAG CAGAGCGGCCCTGGCCTGGTGAAGCCTAGCCAGACACT GTCCCTGACCTGTGCCATCTCTGGCGACAGCGTGAGCTC CAACAGCGCCACCTGGAATTGGATCAGGCAGTCCCCATC |

TABLE 10-continued

Polynucleotide Sequences of exemplary DLL3 targeting CARs

| SEQ ID NO | CAR Structure | Nucleotide Sequence |
|---|---|---|
| | transmembrane regions, 41BB cytoplasmic signaling domain, CD3ζ cytoplasmic signaling domain | TACAGGACTGGAGTGGCTGGCACGGACCTACTATAGATC CAAGTGGTACAACGACTATGAGGTGTCCGTGAAGTCTCA GATCACAATCAACCCTGATACCTCCAAGAATCAGTTCTC TCTGCAGCTGAATAGCGTGACACCAGAGGATACCGCCGT GTACTATTGCGCCAGAGGCGGAATCGTGGGCGCCCCTGA CGCCTTTGATATCTGGGGCCAGGGCACAATGGTGACCGT GTCTAGCGGAGGAGGAGGCTCCGGAGGAGGAGGCTCTG GCGGCGGCGGCAGCGGAGGCGGCGGCAGCCAGTCCGTG CTGACACAGCCCCCTTCTGCCAGCGGAACACCCGGCCAG GGAGTGACCATCTCCTGTTCTGGCTCCTCTAGCAACATC GGCAGCAACCCTGTGAATTGGTACCAGCAGCTGCCAGG CACAGCCCCCAAGCTGCTGATCTATTCCAACAATCAGAG GCCTTCTGGCGTGCCAGACCGCTTCAGCGATTCCAAGTC TGGCACCAGCGCCTCCCTGGCAATCTCTGGACTGCAGAG CGAGGACGAGGCCGATTACTATTGCTCCGCCTGGGACGA TTGGCTGAATGGCTACGTGTTTGGCACAGGCACCAAGGT GACCGTGCTGACCACAACCCCCGCCCCTAGGCCACCTAC CCCAGCACCTACAATTGCTAGTCAGCCACTGTCACTGCG ACCAGAGGCATGTCGACCTGCAGCTGGAGGAGCAGTGC ATACAAGGGGACTGGACTTTGCCTGCGATATCTACATTT GGGCTCCTCTGGCAGGAACATGTGGCGTGCTGCTGCTGA GCCTGGTCATCACTCTGTACTGCAAGCGAGGCCGGAAGA AACTGCTGTATATTTTCAAACAGCCCTTTATGCGACCTGT GCAGACCACACAGGAGGAAGATGGGTGCTCCTGTCGGT TCCCCGAGGAAGAGGAAGGAGGCTGTGAGCTGCGGGTC AAGTTTTCCAGATCTGCAGACGCCCCTGCTTACCAGCAG GGCCAGAACCAGCTGTATAACGAGCTGAATCTGGGGCG GAGAGAGGAATACGACGTGCTGGATAAAAGGCGCGGGA GAGACCCAGAAATGGGGGGAAAGCCACGACGGAAAAA CCCCCAGGAGGGACTGTACAATGAACTGCAGAAGGATA AAATGGCAGAGGCCTATTCCGAAATCGGGATGAAGGGA GAAAGAAGGCGAGGCAAAGGACACGACGGACTGTACCA GGGGCTGTCTACCGCCACAAAGGACACCTATGATGCTCT GCATATGCAGGCACTGCCACCCAGG |
| 608 | CD8α signal sequence, 4H5 scFv, CD8α hinge and transmembrane regions, 41BB cytoplasmic signaling domain, CD3ζ cytoplasmic signaling domain | ATGGCACTGCCAGTGACAGCCCTGCTGCTGCCTCTGGCC CTGCTGCTGCACGCCGCCAGGCCTCAGGTGCAGCTGCAG GAGTCCGGCCCTGGCCTGGTGAAGCCATCCGAGACCCTG TCTCTGACATGCACCGTGTCCGGCGATTCTATCAACAAT TACTTTTGGAGCTGGATCAGACAGCCCCCTGGCAAGGGA CTGGAGTGGATCGGCTACTTCTATCACAGGGGCGGCAAC AATTATAACCCAAGCCTGAAGTCCCGCGTGACAATCAGC ATCGACACCTCCAAGAATCAGTTCAGCCTGAACCTGAAC AGCGTGACAAGCGCCGATACCGCCGTGTACTATTGTGCC CGGCTGGCCCTGGCCGGCTTCTTTTTCGACTACTGGGGC CAGGGCACACTGGTGACCGTGAGCTCCGGAGGAGGAGG CTCCGGCGGCGGAGGCTCTGGCGGCGGCGGCTCCGGAG GCGGCGGCAGCGACATCCAGATGACACAGTCTCCAAGC ACCCTGTCCGCCTCTGTGGGCGATAGGGTGACAATCACC TGCAGAGCCAGCCAGTCCATCTCTAGCTGGCTGGCCTGG TACCAGCAGAAGCCAGGCAAGGCCCCCAAGCTGCTGAT CTATAAGGCCTCCTCTCTGGAGTCTGGCGTGCCAAGCCG GTTTTCTGGCAGCGGCTCCGGCACAGAGTTCACACTGAC CATCAGCTCCCTGCAGCCCGACGATTTTGCCACCTACTA TTGTCAGCAGTACAACTCTTATAGCAGAACATTCGGCCA GGGCACCAAGGTGGAGATCAAGACCACAACCCCTGCCC CTAGGCCACCTACCCCAGCACCTACAATTGCTAGTCAGC CACTGTCACTGCGACCAGAGGCATGTCGACCTGCAGCTG GAGGAGCAGTGCATACAAGGGGACTGGACTTTGCCTGC GATATCTACATTTGGGCTCCTCTGGCAGGAACATGTGGC GTGCTGCTGCTGAGCCTGGTCATCACTCTGTACTGCAAG CGAGGCCGGAAGAAACTGCTGTATATTTTCAAACAGCCC TTTATGCGACCTGTGCAGACCACACAGGAGGAAGATGG GTGCTCCTGTCGGTTCCCCGAGGAAGAGGAAGGAGGCT GTGAGCTGCGGGTCAAGTTTTCCAGATCTGCAGACGCCC CTGCTTACCAGCAGGGCCAGAACCAGCTGTATAACGAG CTGAATCTGGGGCGGAGAGAGGAATACGACGTGCTGGA TAAAAGGCGCGGGAGAGACCCAGAAATGGGGGGAAAG CCACGACGGAAAAACCCCCAGGAGGGACTGTACAATGA ACTGCAGAAGGATAAAATGGCAGAGGCCTATTCCGAAA TCGGGATGAAGGGAGAAAGAAGGCGAGGCAAAGGACA CGACGGACTGTACCAGGGGCTGTCTACCGCCACAAAGG ACACCTATGATGCTCTGCATATGCAGGCACTGCCACCCA GG |

TABLE 10-continued

Polynucleotide Sequences of exemplary DLL3 targeting CARs

| SEQ ID NO | CAR Structure | Nucleotide Sequence |
|---|---|---|
| 609 | CD8α signal sequence, 3G6-L2 scFv, CD8α hinge and transmembrane regions, 41BB cytoplasmic signaling domain, CD3ζ cytoplasmic signaling domain | ATGGCACTGCCAGTGACAGCCCTGCTGCTGCCACTGGCC CTGCTGCTGCACGCCGCCCGGCCACAGGTGCCCCTGGTG CAGTCCGGAGCAGAGGTGAAGAAGCCCGGCAGCTCCGT GAAGGTGTCTTGCAAGGCCAGCGGCGGCACATTCAGCA CCTACAGCATCTCCTGGGTGCGGCAGGCCCCTGGCCAGG GACTGGAGTGGATGGGAGGAATCATCCCAATCTTCGGC ACCACAAACTACGCCCAGAAGTTTCAGGGCAGAGTGAC AATCACCGCCGACAAGTCTACAAGCACCGCCTATATGGA GCTGTCTAGCCTGAGGTCTGAGGACACCGCCGTGTACTA TTGTGCCCGCGATGGCGAGGGCAGCTACTATTACTATTA CGGAATGGACGTGTGGGGACAGGGAACCACAGTGACAG TGTCCTCTGGAGGAGGAGGCAGCGGCGGAGGAGGCTCC GGAGGCGGCGGCTCTGGCGGCGGCGGCTCCCAGTCTGT GCTGACCCAGCCACCTAGCGCCTCCGGAACACCCGGCCA GAGGGTGACCATCTCTTGCAGCGGCAGCTCCTCTAACAT CGGCTCCAATTACGTGTACTGGTATCAGCAGCTGCCTGG CACAGCCCCAAAGCTGCTGATCTACAGCAACAATCAGC GGCCCTCCGGCGTGCCTGACAGATTCTCCGGCTCTAAGA GCGGCACCTCCGCCTCTCTGGCAATCTCCGGACTGCGCT CTGAGGACGAGGCAGATTATTACTGTGCAGCATGGGAC GATAGCCTGTCCGGATGGGTGTTTGGAGGAGGAACAAA GCTGACCGTGCTGACCACAACCCCTGCCCCTAGGCCACC TACCCCAGCACCTACAATTGCTAGTCAGCCACTGTCACT GCGACCAGAGGCATGTCGACCTGCAGCTGGAGGAGCAG TGCATACAAGGGGACTGGACTTTGCCTGCGATATCTACA TTTGGGCTCCTCTGGCAGGAACATGTGGCGTGCTGCTGC TGAGCCTGGTCATCACTCTGTACTGCAAGCGAGGCCGGA AGAAACTGCTGTATATTTTCAAACAGCCCTTTATGCGAC CTGTGCAGACCACACAGGAGGAAGATGGGTGCTCCTGT CGGTTCCCCGAGGAAGAGGAAGGAGGCTGTGAGCTGCG GGTCAAGTTTTCCAGATCTGCAGACGCCCCTGCTTACCA GCAGGGCCAGAACCAGCTGTATAACGAGCTGAATCTGG GCGGAGAGAGGAATACGACGTGCTGGATAAAAGGCGC GGGAGAGACCCAGAAATGGGGGGAAAGCCACGACGGA AAAACCCCAGGAGGGACTGTACAATGAACTGCAGAAG GATAAAATGGCAGAGGCCTATTCCGAAATCGGGATGAA GGGAGAAAGAAGGCGAGGCAAAGGACACGACGGACTG TACCAGGGGCTGTCTACCGCCACAAAGGACACCTATGAT GCTCTGCATATGCAGGCACTGCCACCCAGG |
| 610 | CD8α signal sequence, 3B9 scFv, CD8α hinge and transmembrane regions, 41BB cytoplasmic signaling domain, CD3ζ cytoplasmic signaling domain | ATGGCACTGCCAGTGACAGCCCTGCTGCTGCCACTGGCC CTGCTGCTGCACGCCGCCAGACCCGAGGTGCAGCTGGTG GAGTCCGGAGGAGGACTGGTGCAGCCTGGCGGCTCCCT GAGGCTGTCTTGCGCAGCAAGCGGCTTCACCTTTAGCTC CTACAGCATGAACTGGGTGAGACAGGCCCCCGGCAAGG GACTGGAGTGGGTGTCTTATATCTCTAGCTCCTCTAGCA CAATCTACTATGCCGACAGCGTGAAGGGCCGGTTCACCA TCTCTAGAGATAACGCCAAGAATAGCCTGTACCTGCAGA TGAACAGCCTGAGGGACGAGGATACAGCCGTGTACTAT TGTGCCCGCGACAAGGAGCGGAGATACTATTACTATGGC ATGGACGTGTGGGGCCAGGGCACCACAGTGACCGTGTC CTCTGGCGGCGGCGGCTCCGGAGGCGGCGGCTCTGGAG GAGGAGGCAGCGGCGGAGGAGGCTCCGAGATCGTGCTG ACACAGTCCCCTGACACCCTGTCTCTGAGCCCAGGCGAG AGGGCCACACTGTCTTGCAGGGCATCCCAGTCTGTGAGC AGGCGCTACCTGGCCTGGTATCAGCAGAAGCCTGGCCA GGCCCCCAGACTGCTGATCTACGGAGCAAGCAGCCGGG CCACAGGCATCCCTGACAGATTCTCCGGCTCTGGCAGCG GAACCGACTTCACCCTGACCATCTCCAGGCTGGAGCCAG AGGATTTTGCCGTGTACTATTGTCAGCAGTTCGGCACAA GCCCAATCACCTTTGGCCAGGGAACCCGCCTGGAGATCA AGACCACAACCCCAGCCCCTAGGCCACCTACCCCAGCAC CTACAATTGCTAGTCAGCCACTGTCACTGCGACCAGAGG CATGTCGACCTGCAGCTGGAGGAGCAGTGCATACAAGG GGACTGGACTTTGCCTGCGATATCTACATTTGGGCTCCT CTGGCAGGAACATGTGGCGTGCTGCTGCTGAGCCTGGTC ATCACTCTGTACTGCAAGCGAGGCCGGAAGAAACTGCT GTATATTTTCAAACAGCCCTTTATGCGACCTGTGCAGAC CACACAGGAGGAAGATGGGTGCTCCTGTCGGTTCCCCGA GGAAGAGGAAGGAGGCTGTGAGCTGCGGGTCAAGTTTT CCAGATCTGCAGACGCCCCTGCTTACCAGCAGGGCCAGA ACCAGCTGTATAACGAGCTGAATCTGGGCGGAGAGAG GAATACGACGTGCTGGATAAAAGGCGCGGGAGAGACCC |

TABLE 10-continued

Polynucleotide Sequences of exemplary DLL3 targeting CARs

| SEQ ID NO | CAR Structure | Nucleotide Sequence |
|---|---|---|
| | | AGAAATGGGGGAAAGCCACGACGGAAAAACCCCAG<br>GAGGGACTGTACAATGAACTGCAGAAGGATAAAATGGC<br>AGAGGCCTATTCCGAAATCGGGATGAAGGGAGAAAGAA<br>GGCGAGGCAAAGGACACGACGGACTGTACCAGGGGCTG<br>TCTACCGCCACAAAGGACACCTATGATGCTCTGCATATG<br>CAGGCACTGCCACCCAGG |
| 611 | CD8α signal sequence, 3F9-L scFv, CD8α hinge and transmembrane regions, 41BB cytoplasmic signaling domain, CD3ζ cytoplasmic signaling domain | ATGGCACTGCCAGTGACAGCCCTGCTGCTGCCACTGGCC<br>CTGCTGCTGCACGCCGCCAGACCCCAGGTGCAGCTGCAG<br>CAGAGCGGCCCTGGCCTGGTGAAGCCTAGCCAGACCCT<br>GTCCCTGGCCTGTGCCATCTCTGGCGACAGCGTGAGCTC<br>CAACTCCGCCATCTGGAATTGGATCAGGCAGTCCCCTTC<br>TCGCGGCCTGGAGTGGCTGGGAGGAACATACTATCGGTC<br>TATGTGGTACAACGACTATGCCGTGTCCGTGAAGTCTAG<br>AATCACAATCAACCCTGATACCTCCAAGAATCAGCTGTC<br>TCTGCAGCTGAATAGCGTGACACCAGAGGATACCGCCGT<br>GTACTATTGCAGCCGGGGCGGAATCGTGGGAGTGCCAG<br>ACGCCTTCGATATCTGGGGCCAGGGCACAATGGTGACCG<br>TGTCTAGCGGAGGAGGAGGCTCCGGAGGAGGAGGCTCT<br>GGCGGCGGCGGCAGCGGAGGCGGCGGCAGCCAGTCCGT<br>GCTGACCCAGCCACCTTCTGCCAGCGGAACACCCGGCCA<br>GCGGGTGACCATCTCCTGTTCTGGCTCCTCTAGCAACAT<br>CGGCAGCAACACAGCCAATTGGTACCAGCAGCTGCCAG<br>GCACCGCACCCAGGCTGCTGATCTATCGGAACAATCAGA<br>GACCTTCCGGAGTGCCAGACCGCTTCAGCGGCTCCAAGT<br>CTGGCACAAGCGCCTCCCTGGCCATCTCTGGCCTGCAGA<br>GCGAGGACGAGGCCGATTACTATTGCGCCGCCTGGGAC<br>GATAGCCTGAATGGCTACGTGTTTGGCACAGGCACCAAG<br>GTGACCGTGCTGACCACAACCCCTGCCCCTAGGCCACCT<br>ACCCCAGCACCTACAATTGCTAGTCAGCCACTGTCACTG<br>CGACCAGAGGCATGTCGACCTGCAGCTGGAGGAGCAGT<br>GCATACAAGGGGACTGGACTTTGCCTGCGATATCTACAT<br>TTGGGCTCCTCTGGCAGGAACATGTGGCGTGCTGCTGCT<br>GAGCCTGGTCATCACTCTGTACTGCAAGCGAGGCCGGAA<br>GAAACTGCTGTATATTTTCAAACAGCCCTTTATGCGACC<br>TGTGCAGACCACACAGGAGGAAGATGGGTGCTCCTGTC<br>GGTTCCCCGAGGAAGAGGAAGGAGGCTGTGAGCTGCGG<br>GTCAAGTTTTCCAGATCTGCAGACGCCCCTGCTTACCAG<br>CAGGGCCAGAACCAGCTGTATAACGAGCTGAATCTGGG<br>GCGGAGAGAGGAATACGACGTGCTGGATAAAAGGCGCG<br>GGAGAGACCCAGAAATGGGGGGAAAGCCACGACGGAA<br>AAACCCCCAGGAGGGACTGTACAATGAACTGCAGAAGG<br>ATAAAATGGCAGAGGCCTATTCCGAAATCGGGATGAAG<br>GGAGAAAGAAGGCGAGGCAAAGGACACGACGGACTGT<br>ACCAGGGGCTGTCTACCGCCACAAAGGACACCTATGAT<br>GCTCTGCATATGCAGGCACTGCCACCCAGG |
| 612 | CD8α signal sequence, 3E10 scFv, CD8α hinge and transmembrane regions, 41BB cytoplasmic signaling domain, CD3ζ cytoplasmic signaling domain | ATGGCACTGCCTGTGACAGCCCTGCTGCTGCCACTGGCC<br>CTGCTGCTGCACGCCGCCCGGCCACAGGTGCAGCTGCAG<br>GAGTCCGGCCCAGGCCTGGTGAAGCCATCTGAGACACT<br>GAGCCTGACCTGCAACGTGTCTGATGGCAGCATCAGCTC<br>CTACTATTGGACCTGGATCAGACAGCCCCCTGGCAAGGG<br>ACTGGACTGGATCGGCTATATCTTCTACAGCGGCACCAC<br>AAAACTATAATCCCTCCCTGAAGTCTAGAGTGACAATCTC<br>CCTGGACACCTCTAAGAATCAGTTTTCTCTGAAGCTGAC<br>AAGCATGACCGCCGCCGATACAGCCGTGTACTATTGCGC<br>CAGGATCAGCGAGAAGTCCTTCTATTTTGACTACTGGGG<br>CCAGGGCACACTGGTGACCGTGTCTAGCGGAGGAGGAG<br>GCTCCGGAGGAGGAGGCTCTGGCGGCGGCGGCAGCGGA<br>GGCGGCGGCTCCCAGTCTGTGCTGACCCAGCCACCAAGC<br>GCCTCCGGAACACCTGGCCAGCGCGTGACCATCTCTTGT<br>AGCGGCTCCTCTAGCAACATCGGCTCCAATTACGTGTAT<br>TGGTACCAGCAGCTGCCTGGCACAGCCCCAAAGCTGCTG<br>ATCTACTCCAACAATCAGCGGCCCAGCGGCGTGCCTGAT<br>AGATTCTCCGGCTCTAAGAGCGGCACCTCCGCCTCTCTG<br>GCAATCAGCGGACTGAGGTCCGAGGACGAGGCAGATTA<br>CTATTGTGCACCATGGGACGATAGCCTGTCCGGCCGCGT<br>GTTTGGAGGAGGAACAAAGCTGACCGTGCTGACCACAA<br>CCCCTGCCCCTAGGCCACCTACCCCAGCACCTACAATTG<br>CTAGTCAGCCACTGTCACTGCGACCAGAGGCATGTCGAC<br>CTGCAGCTGGAGGAGCAGTGCATACAAGGGGACTGGAC<br>TTTGCCTGCGATATCTACATTTGGGCTCCTCTGGCAGGA<br>ACATGTGGCGTGCTGCTGCTGAGCCTGGTCATCACTCTG<br>TACTGCAAGCGAGGCCGGAAGAAACTGCTGTATATTTTC |

TABLE 10-continued

Polynucleotide Sequences of exemplary DLL3 targeting CARs

| SEQ ID NO | CAR Structure | Nucleotide Sequence |
|---|---|---|
| | | AAACAGCCCTTTATGCGACCTGTGCAGACCACACAGGA GGAAGATGGGTGCTCCTGTCGGTTCCCCGAGGAAGAGG AAGGAGGCTGTGAGCTGCGGGTCAAGTTTTCCAGATCTG CAGACGCCCCTGCTTACCAGCAGGGCCAGAACCAGCTGT ATAACGAGCTGAATCTGGGGCGGAGAGAGGAATACGAC GTGCTGGATAAAAGGCGCGGGAGAGACCCAGAAATGGG GGGAAAGCCACGACGGAAAAACCCCCAGGAGGGACTGT ACAATGAACTGCAGAAGGATAAAATGGCAGAGGCCTAT TCCGAAATCGGGATGAAGGGAGAAAGAAGGCGAGGCA AAGGACACGACGGACTGTACCAGGGGCTGTCTACCGCC ACAAAGGACACCTATGATGCTCTGCATATGCAGGCACTG CCACCCAGG |
| 613 | CD8α signal sequence, 3C3 scFv, CD8α hinge and transmembrane regions, 41BB cytoplasmic signaling domain, CD3ζ cytoplasmic signaling domain | ATGGCCCTGCCAGTGACCGCCCTGCTGCTGCCACTGGCC CTGCTGCTGCACGCCGCCAGGCCCCAGGTGCAGCTGGTG CAGAGCGGAGCAGAGGTGAAGCGCCCTGGCGCAAGCGT GAAGGTGTCCTGCAAGGCCTCTGGCTATACATTCACCAG CTACTATATCCACTGGGTGAGGCAGGCCCCTGGCCAGGG ACTGGAGTGGATGGGCGTGATCGTGCCATCCGGCGGCTC TATCAGCTATGCCCAGAAGTTTCAGGGCAGGGTGACAAT GACCCGCGACACAAGCACCAACATCGTGTACATGGAGC TGAGCTCCCTGCGGTCCGAGGATACAGCCGTGTACTATT GTGCCAGAGACAGATACTATGGCGATTACTATTACGGAC TGGACGTGTGGGGACAGGGAACCACAGTGACCGTGTCT AGCGGCGGCGGCGGCTCTGGAGGAGGAGGCAGCGGCGG AGGAGGCTCCGGCGGCGGCGGCTCTGACATCCAGATGA CACAGTCCCCTTCCTCTCTGTCCGCCTCTGTGGGCGATCG GGTGACAATCACCTGCAGAGCCTCTCAGGGCATCAACA ATTTCCTGGCCTGGTTTCAGCAGAAGCCCGGCAAGGCCC CTAAGTCCCTGATCTACGCAGCAAGCTCCCTGCAGAGCG GAGTGCCATCCAAGTTCAGCGGCTCCGGCTCTGGCACAG ACTTTACACTGACCATCCGGTCTCTGCAGCCAGAGGATT TCGCCACCTATTACTGTCAGCACTATAATAGCTACCCCA TCACATTTGGCCAGGGCACCAGACTGGAGATCAAGACC ACAACCCCCGCCCCTAGGCCACCTACCCCAGCACCTACA ATTGCTAGTCAGCCACTGTCACTGCGACCAGAGGCATGT CGACCTGCAGCTGGAGGAGCAGTGCATACAAGGGGACT GGACTTTGCCTGCGATATCTACATTTGGGCTCCTCTGGC AGGAACATGTGGCGTGCTGCTGCTGAGCCTGGTCATCAC TCTGTACTGCAAGCGAGGCCGGAAGAAACTGCTGTATAT TTTCAAACAGCCCTTTATGCGACCTGTGCAGACCACACA GGAGGAAGATGGGTGCTCCTGTCGGTTCCCCGAGGAAG AGGAAGGAGGCTGTGAGCTGCGGGTCAAGTTTTCCAGA TCTGCAGACGCCCCTGCTTACCAGCAGGGCCAGAACCAG CTGTATAACGAGCTGAATCTGGGGCGGAGAGAGGAATA CGACGTGCTGGATAAAAGGCGCGGGAGAGACCCAGAAA TGGGGGGAAAGCCACGACGGAAAAACCCCCAGGAGGG ACTGTACAATGAACTGCAGAAGGATAAAATGGCAGAGG CCTATTCCGAAATCGGGATGAAGGGAGAAAGAAGGCGA GGCAAAGGACACGACGGACTGTACCAGGGGCTGTCTAC CGCCACAAAGGACACCTATGATGCTCTGCATATGCAGGC ACTGCCACCCAGG |
| 614 | CD8α signal sequence, 11F4 scFv, CD8α hinge and transmembrane regions, 41BB cytoplasmic signaling domain, CD3ζ cytoplasmic signaling domain | ATGGCACTGCCAGTGACAGCCCTGCTGCTGCCTCTGGCC CTGCTGCTGCACGCCGCCCGGCCACAGGTGCACCTGCAG GAGTCTGGCCCTGGCCTGGTGAAGCCATCTGAGACACTG AGCCTGACATGTACCGTGAGCGGCGGCAGCATCTCCCAC TACTATTGGACCTGGATCAGGCAGCCCCCTGGCAAGGGA CTGGAGTGGATCGGCTACATCTACTATTCCGGCATCACC AACTTCTCTCCTAGCCTGAAGTCTCGCGTGTCCATCTCTG TGGACAGCTCCAAGAATCAGTTCAGCCTGAACCTGAACA GCGTGACAGCCGCCGATACCGCCGTGTACTATTGCGCCG GCATCTCCCTGGCCGGCTTCTACTTTGACTATTGGGTGCA GGGCACACTGGTGACCGTGTCTAGCGGAGGAGGAGGCA GCGGAGGAGGAGGCTCCGGAGGCGGCGGCTCTGGCGGC GGCGGCAGCGAGATCGTGCTGACACAGAGCCCAGGCAC CCTGAGCCTGTCCCCCGGCGAGCGGGCCACCCTGTCCTG TAGAGCCTCTCAGAGCGTGTCCCGGTCTTACCTGGCCTG GTATCAGCAGAAGCCAGGCCAGGCCCCCAGACTGCTGA TCTATGGAGCATCCTCTAGGGCCACAGGAGTGCCAGACC GCTTCAGCGGCTCCGGCTCTGGAACCGACTTCACCCTGA CCATCAGCCGGCTGGAGCCTGAGGATTTCGCCGTGTTTT ACTGCCAGCAGTATAGCATCTCCCCACTGACATTCGGCG GCGGCACCAAGGTGGAGATCAAGACCACAACCCCCTGCC |

TABLE 10-continued

Polynucleotide Sequences of exemplary DLL3 targeting CARs

| SEQ ID NO | CAR Structure | Nucleotide Sequence |
|---|---|---|
| | | CCTAGGCCACCTACCCCAGCACCTACAATTGCTAGTCAG<br>CCACTGTCACTGCGACCAGAGGCATGTCGACCTGCAGCT<br>GGAGGAGCAGTGCATACAAGGGGACTGGACTTTGCCTG<br>CGATATCTACATTTGGGCTCCTCTGGCAGGAACATGTGG<br>CGTGCTGCTGCTGAGCCTGGTCATCACTCTGTACTGCAA<br>GCGAGGCCGGAAGAAACTGCTGTATATTTTCAAACAGCC<br>CTTTATGCGACCTGTGCAGACCACACAGGAGGAAGATG<br>GGTGCTCCTGTCGGTTCCCCGAGGAAGAGGAAGGAGGC<br>TGTGAGCTGCGGGTCAAGTTTTCCAGATCTGCAGACGCC<br>CCTGCTTACCAGCAGGGCCAGAACCAGCTGTATAACGA<br>GCTGAATCTGGGGCGGAGAGAGGAATACGACGTGCTGG<br>ATAAAAGGCGCGGGAGAGACCCAGAAATGGGGGGAAA<br>GCCACGACGGAAAAACCCCCAGGAGGGACTGTACAATG<br>AACTGCAGAAGGATAAAATGGCAGAGGCCTATTCCGAA<br>ATCGGGATGAAGGGAGAAAGAAGGCGAGGCAAAGGAC<br>ACGACGGACTGTACCAGGGGCTGTCTACCGCCACAAAG<br>GACACCTATGATGCTCTGCATATGCAGGCACTGCCACCC<br>AGG |
| 615 | CD8α signal sequence, 10E12 scFv, CD8α hinge and transmembrane regions, 41BB cytoplasmic signaling domain, CD3ζ cytoplasmic signaling domain | ATGGCACTGCCTGTGACAGCCCTGCTGCTGCCACTGGCC<br>CTGCTGCTGCACGCCGCCCGGCCCCAGGTGCAGCTGCAG<br>GAGTCCGGCCCAGGCCTGGTGAAGCCAAGCGAGACCCT<br>GTCCCTGACATGCACCGTGTCCGGCGTGTCTATCAGCTC<br>CTACTATTGGAGCTGGATCAGGCAGCCCCCTGGCAAGGG<br>ACTGGAGTGGATCGCCTACATCTACTATTCCGGCAACAC<br>CAATTATTCTCCTAGCCTGAAGTCTCGCGTGACAATCTCT<br>GTGGACACCAGCAAGGATCAGCTGTCTCTGAAGCTGTCT<br>AGCGTGACAGCCGCCGACACCGCCGTGTACTATTGCACA<br>AGGGGCGGCAGCGGAACCATCGACGTGTTCGATATCTG<br>GGGACAGGGAACCATGGTGGCCGTGTCCTCTGGCGGCG<br>GCGGCTCCGGAGGCGGCGGCTCTGGAGGAGGAGGCAGC<br>GGCGGAGGAGGCTCCCAGTCTGTGCTGACACAGCCACC<br>AAGCGTGTCCGCCGCCCCAGGCCAGAAGGTGACCATCTC<br>TTGTAGCGGCAGCTCCTCTAACATCGGCAACAATTACGT<br>GTCCTGGTATCAGCAGCTGCCTGGCACAGCCCCAAAGCT<br>GCTGATCTACGACAACAATAAGCGGCCCAGCGGCATCC<br>CTGATAGATTCTCCGGCTCTAAGAGCGGCACATCCGCCA<br>CCCTGGGCATCACAGGACTGCAGACCGGCGACGAGGCA<br>GATTACTATTGTGAGACCTGGGATAGCTCCCTGAGCGCC<br>GTGGTGTTTGGAGGAGGCACAAAGCTGACCGTGCTGAC<br>CACAACCCCTGCCCCTAGGCCACCTACCCCAGCACCTAC<br>AATTGCTAGTCAGCCACTGTCACTGCGACCAGAGGCATG<br>TCGACCTGCAGCTGGAGGAGCAGTGCATACAAGGGGAC<br>TGGACTTTGCCTGCGATATCTACATTTGGGCTCCTCTGGC<br>AGGAACATGTGGCGTGCTGCTGCTGAGCCTGGTCATCAC<br>TCTGTACTGCAAGCGAGGCCGGAAGAAACTGCTGTATAT<br>TTTCAAACAGCCCTTTATGCGACCTGTGCAGACCACACA<br>GGAGGAAGATGGGTGCTCCTGTCGGTTCCCCGAGGAAG<br>AGGAAGGAGGCTGTGAGCTGCGGGTCAAGTTTTCCAGA<br>TCTGCAGACGCCCCTGCTTACCAGCAGGGCCAGAACCAG<br>CTGTATAACGAGCTGAATCTGGGGCGGAGAGAGGAATA<br>CGACGTGCTGGATAAAAGGCGCGGGAGAGACCCAGAAA<br>TGGGGGGAAAGCCACGACGGAAAAACCCCCAGGAGGG<br>ACTGTACAATGAACTGCAGAAGGATAAAATGGCAGAGG<br>CCTATTCCGAAATCGGGATGAAGGGAGAAAGAAGGCGA<br>GGCAAAGGACACGACGGACTGTACCAGGGGCTGTCTAC<br>CGCCACAAAGGACACCTATGATGCTCTGCATATGCAGGC<br>ACTGCCACCCAGG |
| 616 | CD8α signal sequence, 4E1 scFv, CD8α hinge and transmembrane regions, 41BB cytoplasmic signaling domain, CD3ζ cytoplasmic signaling domain | ATGGCACTGCCTGTGACAGCCCTGCTGCTGCCACTGGCC<br>CTGCTGCTGCACGCCGCCCGGCCTCAGGTGCAGCTGCAG<br>CAGAGCGGCCCAGGCCTGGTGAAGCCATCCCAGACACT<br>GTCTCTGACCTGCGCCATCTCCGGCGACAACGTGTCCAC<br>AAATTCTGCCGCCTGGAACTGGATCAGGCAGAGCCCATC<br>CCGCGGCCTGGAGTGGCTGGGCTGGACCTACTATAGGA<br>GCAAGTGGTACAATGACTATGCCGTGAGCCTGAAGTCCC<br>GCATCAACATCAATCCAGATACCTCCAAGAACCAGTTCT<br>CTCTGCAGCTGAATAGCGTGACACCCGAGGATACCGCCG<br>TGTACTATTGCGCCCGGTGGGTGAACAGAGACGTGTTTG<br>ATATCTGGGGCCAGGGCACAATGGTGACCGTGAGCTCC<br>GGAGGAGGAGGCTCCGGCGGCGAGGCTCTGGCGGCGG<br>CGGCAGCGGAGGCGGCGGCTCTCAGAGCGCCCTGACAC<br>AGCCAGCATCCGTGTCTGGCAGCCCTGGCCAGAGCATCA<br>CCATCTCCTGTACAGGCACCTCTAGCGACGTGGGCTCCT |

TABLE 10-continued

Polynucleotide Sequences of exemplary DLL3 targeting CARs

| SEQ ID NO | CAR Structure | Nucleotide Sequence |
|---|---|---|
| | | ACAATCTGGTGTCTTGGTATCAGCAGCACCCCGGCAAGG<br>CCCCTAAGCTGATGATCTACGAGGGCAGCAAGAGGCCA<br>TCTGGCGTGAGCAACAGATTCTCCGGCTCTAAGAGCGGC<br>AATACAGCCTCTCTGACCATCAGCGGACTGCAGGCAGA<br>GGACGAGGCAGATTACTATTGCTGTTCCTATGCCGGCTC<br>CTCTACCTGGGTGTTTGGCGGCGGCACAAAGCTGACCGT<br>GCTGACCACAACCCCTGCCCCTAGGCCACCTACCCCAGC<br>ACCTACAATTGCTAGTCAGCCACTGTCACTGCGACCAGA<br>GGCATGTCGACCTGCAGCTGGAGGAGCAGTGCATACAA<br>GGGGACTGGACTTTGCCTGCGATATCTACATTTGGGCTC<br>CTCTGGCAGGAACATGTGGCGTGCTGCTGCTGAGCCTGG<br>TCATCACTCTGTACTGCAAGCGAGGCCGGAAGAAACTGC<br>TGTATATTTTCAAACAGCCCTTTATGCGACCTGTGCAGA<br>CCACACAGGAGGAAGATGGGTGCTCCTGTCGGTTCCCCG<br>AGGAAGAGGAAGGAGGCTGTGAGCTGCGGGTCAAGTTT<br>TCCAGATCTGCAGACGCCCCTGCTTACCAGCAGGGCCAG<br>AACCAGCTGTATAACGAGCTGAATCTGGGGCGGAGAGA<br>GGAATACGACGTGCTGGATAAAAGGCGCGGGAGAGACC<br>CAGAAATGGGGGAAAGCCACGACGGAAAAACCCCCAG<br>GAGGGACTGTACAATGAACTGCAGAAGGATAAAATGGC<br>AGAGGCCTATTCCGAAATCGGGATGAAGGGAGAAAGAA<br>GGCGAGGCAAAGGACACGACGGACTGTACCAGGGGCTG<br>TCTACCGCCACAAAGGACACCTATGATGCTCTGCATATG<br>CAGGCACTGCCACCCAGG |
| 617 | CD8α signal sequence, 2404.6H1 scFv, CD8α hinge and transmembrane regions, 41BB cytoplasmic signaling domain, CD3ζ cytoplasmic signaling domain | ATGGCCCTGCCAGTGACCGCCCTGCTGCTGCCCCTGGCC<br>CTGCTGCTGCACGCCGCCAGGCCCCAGGTGCAGCTGGTG<br>GAGTCCGGAGGAGGAGTGGTGCAGCCTGGCCGGTCTCT<br>GAGACTGAGCTGCGCAGCATCCGGCTTCACCTTCAGCTC<br>CTACGGAATGCACTGGGTGCGGCAGACCCCTGGCAAGG<br>GACTGGAGTGGGTGGCCGTGATCTCCTATGACGGCAACT<br>CTAATTACTATGCCGATAGCGTGAAGGGCAGGTTCACAA<br>TCTCTCGCGACAACAGCAAGAATACCCTGTACCTGCAGA<br>TGAACTCTCTGCGGGCCGAGGACACAGCCGTGTACTATT<br>GTGCCAGAGATGGCGCCACAGTGACCAGCTACTATTACT<br>ATGGCATGGACGTGTGGGGCCAGGGCACCACAGTGACC<br>GTGTCTAGCGGAGGAGGAGGCAGCGGAGGAGGAGGCTC<br>CGGAGGCGGCGGCTCTGGCGGCGGCGGCAGCGAGATCG<br>TGCTGACACAGTCCCCTGGCACCCTGAGCCTGTCCCCAG<br>GCGAGCGGGCCACACTGTCTTGCAGAGCCTCTCAGAGCG<br>TGTCCAGGACCTACCTGGCCTGGTATCACCAGAAGCCTG<br>GCCAGGCACCTCGCCTGCTGATCTACGGAGCATCCTCTA<br>GGGCCACAGGCATCAGCGACCGCTTCTCTGGCAGCGGCT<br>CCGGAACCGACTTCACCCTGACCATCTCCCGGCTGGAGC<br>CAGAGGACTTCGCCGTGTACTATTGTCAGCAGTATGGCA<br>CATCCCCCATCACCTTTGGCCAGGGCACCAGACTGGAGA<br>TCAAGACCACAACCCCCGCCCCTAGGCCACCTACCCCAG<br>CACCTACAATTGCTAGTCAGCCACTGTCACTGCGACCAG<br>AGGCATGTCGACCTGCAGCTGGAGGAGCAGTGCATACA<br>AGGGGACTGGACTTTGCCTGCGATATCTACATTTGGGCT<br>CCTCTGGCAGGAACATGTGGCGTGCTGCTGCTGAGCCTG<br>GTCATCACTCTGTACTGCAAGCGAGGCCGGAAGAAACT<br>GCTGTATATTTTCAAACAGCCCTTTATGCGACCTGTGCA<br>GACCACACAGGAGGAAGATGGGTGCTCCTGTCGGTTCCC<br>CGAGGAAGAGGAAGGAGGCTGTGAGCTGCGGGTCAAGT<br>TTTCCAGATCTGCAGACGCCCCTGCTTACCAGCAGGGCC<br>AGAACCAGCTGTATAACGAGCTGAATCTGGGGCGGAGA<br>GAGGAATACGACGTGCTGGATAAAAGGCGCGGGAGAGA<br>CCCAGAAATGGGGGAAAGCCACGACGGAAAAACCCCC<br>AGGAGGGACTGTACAATGAACTGCAGAAGGATAAAATG<br>GCAGAGGCCTATTCCGAAATCGGGATGAAGGGAGAAAG<br>AAGGCGAGGCAAAGGACACGACGGACTGTACCAGGGGC<br>TGTCTACCGCCACAAAGGACACCTATGATGCTCTGCATA<br>TGCAGGCACTGCCACCCAGG |
| 618 | CD8α signal sequence, 2A8 scFv, CD8α hinge and transmembrane regions, 41BB | ATGGCACTGCCTGTGACAGCCCTGCTGCTGCCACTGGCC<br>CTGCTGCTGCACGCCGCCAGGCCCCAGGTGCAGCTGCAG<br>CAGAGCGGCCCAGGCCTGGTGAAGCCATCTCAGACACT<br>GAGCCTGACCTGCGCCATCTCTGGCGACAGCGTGAGCTC<br>CAACTCCGCCGTGTGGAATTGGATCAGGCAGAGCCCTTC<br>CCGCGGCCTGGAGTGGCTGGGACGGACCTACTATAGATC<br>TAAGTGGTACAACGACTATGCCGTGTCCGTGAAGTCTAG |

TABLE 10-continued

Polynucleotide Sequences of exemplary DLL3 targeting CARs

| SEQ ID NO | CAR Structure | Nucleotide Sequence |
|---|---|---|
| | cytoplasmic signaling domain, CD3ζ cytoplasmic signaling domain | GATCACAATCAACCCCGATACCTCCCGCAATCAGTTCTC TCTGCAGCTGAATAGCGTGACACCTGAGGATACCGCCGT GTACTATTGCGCCAGAGGCGGAATCGTGGGCGCCCCAG ACGGCTTTGATATCTGGGGCCAGGGCACAATGGTGACCG TGTCTAGCGGAGGAGGAGGCTCCGGAGGAGGAGGCTCT GGCGGCGGCGGCAGCGGAGGCGGCGGCTCCGACATCGT GATGACACAGAGCCCTGATTCCCTGGCCGTGTCTCTGGG CGAGAGGGCAACCATCAACTGTAAGTCCTCTCAGAGCGT GCTGGACAGCTCCAACAATAACAATTACTTCGCCTGGTA TCAGCAGAGACCTGGCCAGCCCCCTCACCTGCTGATCTA CTGGGCATCTAGCCGGGAGAGCGGAGTGCCAGACAGAT TCTCTGGCAGCGGCTCCGGCACAGACTTCACCCTGACCA TCTCCTCTCTGCAGGCCGAGGATGTGGCCGTGTACTATT GTCAGCAGTACTATTCCACACCATATACCTTTGGCCAGG GCACCAAGCTGGAGATCAAGACCACAACCCCCGCCCCT AGGCCACCTACCCCAGCACCTACAATTGCTAGTCAGCCA CTGTCACTGCGACCAGAGGCATGTCGACCTGCAGCTGGA GGAGCAGTGCATACAAGGGGACTGGACTTTGCCTGCGA TATCTACATTTGGGCTCCTCTGGCAGGAACATGTGGCGT GCTGCTGCTGAGCCTGGTCATCACTCTGTACTGCAAGCG AGGCCGGAAGAAACTGCTGTATATTTTCAAACAGCCCTT TATGCGACCTGTGCAGACCACACAGGAGGAAGATGGGT GCTCCTGTCGGTTCCCCGAGGAAGAGGAAGGAGGCTGT GAGCTGCGGGTCAAGTTTTCCAGATCTGCAGACGCCCCT GCTTACCAGCAGGGCCAGAACCAGCTGTATAACGAGCT GAATCTGGGGCGGAGAGAGGAATACGACGTGCTGGATA AAAGGCGCGGGAGAGACCCAGAAATGGGGGGAAAGCC ACGACGGAAAAACCCCCAGGAGGGACTGTACAATGAAC TGCAGAAGGATAAAATGGCAGAGGCCTATTCCGAAATC GGGATGAAGGGAGAAAGAAGGCGAGGCAAAGGACACG ACGGACTGTACCAGGGGCTGTCTACCGCCACAAAGGAC ACCTATGATGCTCTGCATATGCAGGCACTGCCACCCAGG |
| 619 | CD8α signal sequence, 3B1 scFv, CD8α hinge and transmembrane regions, 41BB cytoplasmic signaling domain, CD3ζ cytoplasmic signaling domain | ATGGCCCTGCCAGTGACCGCCCTGCTGCTGCCACTGGCC CTGCTGCTGCACGCCGCCCGGCCACAGGTGCAGCTGCAG CAGAGCGGCCCTGGCCTGGTGAAGCCTAGCCAGACACT GTCCCTGACCTGCGCCATCTCTGGCGACAGCGTGAGCTC CAACACCACAGCCTGGAAGTGGAGCAGACAGTCCCCCT CTAAGGGCCTGGAGTGGCTGGGCTGGACATACTATAGGT CCAAGTGGTACTATGACTACACCGTGTCCGTGAAGTCTC GCATCACAATCAACCCCGATACCTCCAAGAATCAGTTCT CTCTGCAGCTGAATAGCGTGACACCTGAGGATACCGCCG TGTACTATTGCGCCAGGTGGATCTTCCACGACGCCTTTG ATATCTGGGGCCAGGGCACAATGGTGACCGTGTCTAGCG GAGGAGGAGGCTCCGGAGGAGGAGGCTCTGGCGGCGGC GGCAGCGGAGGCGGCGGCAGCCAGTCCGCCCTGACACA GCCACCTTCTGCCAGCGGAACACCTGGCCAGAGAGTGA CCATCTCCTGTTCTGGCTCCTCTAGCAACATCGGCAGCA ACACCGTGAATTGGTACCAGCAGCTGCCAGGCACAGCC CCCAAGCTGCTGATCTATACCAACAATCAGAGGCCTTCC GGAGTGCCAGACCGGTTCAGCGGCTCCAAGTCTGGCAC AAGCGCCTCCCTGGCCATCTCTGGCCTGCAGAGCGAGGA CGAGGCCGATTATTTCTGTTCCACCTGGGACGATTCTCT GAATGGACCCGTGTTCGGAGGAGGAACAAAGCTGACCG TGCTGACCACAACCCCAGCCCCTAGGCCACCTACCCCAG CACCTACAATTGCTAGTCAGCCACTGTCACTGCGACCAG AGGCATGTCGACCTGCAGCTGGAGGAGCAGTGCATACA AGGGGACTGGACTTTGCCTGCGATATCTACATTTGGGCT CCTCTGGCAGGAACATGTGGCGTGCTGCTGCTGAGCCTG GTCATCACTCTGTACTGCAAGCGAGGCCGGAAGAAACT GCTGTATATTTTCAAACAGCCCTTTATGCGACCTGTGCA GACCACACAGGAGGAAGATGGGTGCTCCTGTCGGTTCCC CGAGGAAGAGGAAGGAGGCTGTGAGCTGCGGGTCAAGT TTTCCAGATCTGCAGACGCCCCTGCTTACCAGCAGGGCC AGAACCAGCTGTATAACGAGCTGAATCTGGGGCGGAGA GAGGAATACGACGTGCTGGATAAAAGGCGCGGGAGAGA CCCAGAAATGGGGGGAAAGCCACGACGGAAAAACCCCC AGGAGGGACTGTACAATGAACTGCAGAAGGATAAAATG GCAGAGGCCTATTCCGAAATCGGGATGAAGGGAGAAAG AAGGCGAGGCAAAGGACACGACGGACTGTACCAGGGGC TGTCTACCGCCACAAAGGACACCTATGATGCTCTGCATA TGCAGGCACTGCCACCCAGG |

TABLE 10-continued

Polynucleotide Sequences of exemplary DLL3 targeting CARs

| SEQ ID NO | CAR Structure | Nucleotide Sequence |
|---|---|---|
| 620 | CD8α signal sequence, 9B5 scFv, CD8α hinge and transmembrane regions, 41BB cytoplasmic signaling domain, CD3ζ cytoplasmic signaling domain | ATGGCACTGCCTGTGACAGCCCTGCTGCTGCCACTGGCC CTGCTGCTGCACGCCGCCAGACCCCAGGTGCAGCTGCAG GAGTCCGGCCCAGGCCTGGTGAAGCCAAGCGAGACCCT GTCCCTGACATGCACCGTGTCTGGCGACAGCATCAGCTC CCTGTCTTGGAGCTGGATCAGGCAGACACCAGGCGAGG GCCTGGAGTGGATCGGCTACCTGTACTATTCCGGCTCTA CCGACTATAACCCCTCCCTGAAGTCTCGCGTGACAATCT CTGTGGATACCAGCAAGAATCAGTTCTCTCTGAAGCTGC GGAGCGTGGCTGCCGCCGACACAGCCCTGTACTATTGCG CCAGAGGCCGGAGAGCCTTTGATATCTGGGGCCAGGGC ACAATGGTGACCGTGTCTAGCGGAGGAGGAGGCTCCGG AGGAGGAGGCTCTGGCGGCGGCGGCAGCGGAGGCGGCG GCTCCGACATCCAGATGACCCAGAGCCCTTCCTCTCTGA GCGCCTCCGTGGGCGATAGGGTGACAATCACCTGTCGCG GCTCCCAGGGCATCTCTAACTACCTGGCATGGTTCCAGC AGCGGCCCGGCAAGGCACCTAAGTCTCTGATCTATGCAG CAAGCTCCCTGGAGAGCGGAGTGCCATCCAAGTTCTCTG GCAGCGGCTCCGGCACAGACTTTACACTGACCATCATCA GCCTGCAGCCCGAGGATTTCGCCACCTACTATTGTCAGC AGTACTATAATTACCCTATCACATTTGGCCAGGGCACCC GGCTGGAGATCAAGACCACAACCCCTGCCCCTAGGCCA CCTACCCCAGCACCTACAATTGCTAGTCAGCCACTGTCA CTGCGACCAGAGGCATGTCGACCTGCAGCTGGAGGAGC AGTGCATACAAGGGGACTGGACTTTGCCTGCGATATCTA CATTTGGGCTCCTCTGGCAGGAACATGTGGCGTGCTGCT GCTGAGCCTGGTCATCACTCTGTACTGCAAGCGAGGCCG GAAGAAACTGCTGTATATTTTCAAACAGCCCTTTATGCG ACCTGTGCAGACCACACAGGAGGAAGATGGGTGCTCCT GTCGGTTCCCCGAGGAAGAGGAAGGAGGCTGTGAGCTG CGGGTCAAGTTTTCCAGATCTGCAGACGCCCCTGCTTAC CAGCAGGGCCAGAACCAGCTGTATAACGAGCTGAATCT GGGGCGGAGAGAGGAATACGACGTGCTGGATAAAAGGC GCGGGAGAGACCCAGAAATGGGGGGAAAGCCACGACG GAAAAACCCCCAGGAGGGACTGTACAATGAACTGCAGA AGGATAAAATGGCAGAGGCCTATTCCGAAATCGGGATG AAGGGAGAAAGAAGGCGAGGCAAAGGACACGACGGAC TGTACCAGGGGCTGTCTACCGCCACAAAGGACACCTATG ATGCTCTGCATATGCAGGCACTGCCACCCAGG |
| 621 | CD8α signal sequence, 11A5 scFv, CD8α hinge and transmembrane regions, 41BB cytoplasmic signaling domain, CD3ζ cytoplasmic signaling domain | ATGGCACTGCCTGTGACCGCCCTGCTGCTGCCACTGGCC CTGCTGCTGCACGCCGCCCGGCCACAGGTGCAGCTGGTG CAGTCTGGAGCAGAGGTGAAGAAGCCTGGCGCAAGCGT GAAGGTGTCCTGCAAGGCCTCTGGCTACACATTCACCGG CTACTATATGCACTGGGTGAGACAGGCCCCTGGCCAGGG ACTGGAGTGGATGGGCTGGATCAACCCTAATAGCGGCG GCACCAACTACGCCCAGAAGTTTCAGGGCCGGGTGACA ATGACCAGAGACACCAGCGTGTCCACAGCCTATATGGA GCTGAGCAGGCTGACCTCCGACGATACAGCCATCTACTA TTGTGCCAAGGACGGCGGCGGCGATTTCTACTTTTATGG CATGGACGTGTGGGGCCAGGGCACCACAGTGACCGTGA GCTCCGGCGGCGGCGGCTCTGGAGGAGGAGGCAGCGGC GGAGGAGGCTCCGGAGGAGGCGGCTCTCAGACCGTGGT GACACAGGAGCCATCTTTCAGCGTGTCCCCGGCGGAAC AGTGACCCTGACATGCGGCCTGTCTAGCGGCTCTGTGAG CACATCCTACTATCCTAGCTGTTTCCAGCAGACCCCCGG CCAGGCACCTAGAACACTGATCTACTCCACCGACACAAG GTCCTCTGGCGTGCCAGATCGCTTTTCTGGCAGCATCCT GGGCAATAAGGCCGCCCTGACCATCACAGGAGCACAGG CCGACGATGAGTCCGACTACTATTGCGTGCTGTATATGG GCTCCGGAATCAGCGTGTTCGGAGGAGGCACCAAGCTG ACAGTGCTGACCACAACCCCCGCCCCTAGGCCACCTACC CCAGCACCTACAATTGCTAGTCAGCCACTGTCACTGCGA CCAGAGGCATGTCGACCTGCAGCTGGAGGAGCAGTGCA TACAAGGGGACTGGACTTTGCCTGCGATATCTACATTTG GGCTCCTCTGGCAGGAACATGTGGCGTGCTGCTGCTGAG CCTGGTCATCACTCTGTACTGCAAGCGAGGCCGGAAGAA ACTGCTGTATATTTTCAAACAGCCCTTTATGCGACCTGTG CAGACCACACAGGAGGAAGATGGGTGCTCCTGTCGGTT CCCCGAGGAAGAGGAAGGAGGCTGTGAGCTGCGGGTCA AGTTTTCCAGATCTGCAGACGCCCCTGCTTACCAGCAGG GCCAGAACCAGCTGTATAACGAGCTGAATCTGGGGCGG AGAGAGGAATACGACGTGCTGGATAAAAGGCGCGGGAG AGACCCAGAAATGGGGGGAAAGCCACGACGGAAAAAC |

TABLE 10-continued

Polynucleotide Sequences of exemplary DLL3 targeting CARs

| SEQ ID NO | CAR Structure | Nucleotide Sequence |
|---|---|---|
| | | CCCCAGGAGGGACTGTACAATGAACTGCAGAAGGATAA<br>AATGGCAGAGGCCTATTCCGAAATCGGGATGAAGGGAG<br>AAAGAAGGCGAGGCAAAGGACACGACGGACTGTACCAG<br>GGGCTGTCTACCGCCACAAAGGACACCTATGATGCTCTG<br>CATATGCAGGCACTGCCACCCAGG | b. Safety Switches and Monoclonal Antibody Specific-Epitopes

Safety Switches

It will be appreciated that adverse events may be minimized by transducing the immune cells (containing one or more CARs) with a suicide gene. It may also be desired to incorporate an inducible "on" or "accelerator" switch into the immune cells. Suitable techniques include use of inducible caspase-9 (U.S. Appl. 2011/0286980) or a thymidine kinase, before, after or at the same time, as the cells are transduced with the CAR construct of the present disclosure. Additional methods for introducing suicide genes and/or "on" switches include TALENS, zinc fingers, RNAi, siRNA, shRNA, antisense technology, and other techniques known in the art.

In accordance with the disclosure, additional on-off or other types of control switch techniques may be incorporated herein. These techniques may employ the use of dimerization domains and optional activators of such domain dimerization. These techniques include, e.g., those described by Wu et al., Science 2014 350 (6258) utilizing FKBP/Rapalog dimerization systems in certain cells, the contents of which are incorporated by reference herein in their entirety. Additional dimerization technology is described in, e.g., Fegan et al. Chem. Rev. 2010, 110, 3315-3336 as well as U.S. Pat. Nos. 5,830,462; 5,834,266; 5,869,337; and 6,165,787, the contents of which are also incorporated by reference herein in their entirety. Additional dimerization pairs may include cyclosporine-A/cyclophilin, receptor, estrogen/estrogen receptor (optionally using tamoxifen), glucocorticoids/glucocorticoid receptor, tetracycline/tetracycline receptor, vitamin D/vitamin D receptor. Further examples of dimerization technology can be found in e.g., WO 2014/127261, WO 2015/090229, US 2014/0286987, US2015/0266973, US2016/0046700, U.S. Pat. No. 8,486,693, US 2014/0171649, and US 2012/0130076, the contents of which are further incorporated by reference herein in their entirety.

In some embodiments, the CAR-immune cell (e.g., CAR-T cell) of the disclosure comprises a polynucleotide encoding a suicide polypeptide, such as for example RQR8. See, e.g., WO2013153391A, which is hereby incorporated by reference in its entirety. In CAR-immune cell (e.g., CAR-T cell) cells comprising the polynucleotide, the suicide polypeptide is expressed at the surface of a CAR-immune cell (e.g., CAR-T cell). In some embodiments, the suicide polypeptide comprises the amino acid sequence shown in SEQ ID NO: 552:

(SEQ ID NO: 552)
CPYSNPSLCSGGGGSELPTQGTFSNVSTNVSPAKPTTTACPYSNPSLCS

GGGGSPAPRPPTPAPTIASQPLSLRPEACRPAAGGAVHTRGLDFACDIY

IWAPLAGTCGVLLLSLVITLYCNHRNRRRVCKCPRPVV

The suicide polypeptide may also comprise a signal peptide at the amino terminus—for example, MGTSLLCW-MALCLLGADHADA (SEQ ID NO: 553). In some embodiments, the suicide polypeptide comprises the amino acid sequence shown in SEQ ID NO: 554, which includes the signal sequence of SEQ ID NO: 553:

(SEQ ID NO: 554)
MGTSLLCWMALCLLGADHADACPYSNPSLCSGGGGSELPTQGTFSNVST

NVSPAKPTTTACPYSNPSLCSGGGGSPAPRPPTPAPTIASQPLSLRPEA

CRPAAGGAVHTRGLDFACDIYIWAPLAGTCGVLLLSLVITLYCNHRNRR

RVCKCPRPVV

When the suicide polypeptide is expressed at the surface of a CAR-immune cell (e.g., CAR-T cell), binding of rituximab to the R epitopes of the polypeptide causes lysis of the cell. More than one molecule of rituximab may bind per polypeptide expressed at the cell surface. Each R epitope of the polypeptide may bind a separate molecule of rituximab. Deletion of DLL3-specific CAR-immune cell (e.g., CAR-T cell) may occur in vivo, for example by administering rituximab to a patient. The decision to delete the transferred cells may arise from undesirable effects being detected in the patient which are attributable to the transferred cells, such as for example, when unacceptable levels of toxicity are detected.

In some embodiments, a suicide polypeptide is expressed on the surface of the cell. In some embodiments, a suicide polypeptide is included in the CAR construct. In some embodiments, a suicide polypeptide is not part of the DLL3 CAR construct.

In some embodiments, the extracellular domain of any one of the DLL3-specific CARs disclosed herein may comprise one or more epitopes specific for (i.e., specifically recognized by) a monoclonal antibody. These epitopes are also referred to herein as mAb-specific epitopes. Exemplary mAb-specific epitopes are disclosed in International Patent Publication No. WO 2016/120216, which is incorporated herein in its entirety. In these embodiments, the extracellular domain of the CARs comprise antigen binding domains that specifically bind to DLL3 and one or more epitopes that bind to one or more monoclonal antibodies (mAbs). CARs comprising the mAb-specific epitopes can be single-chain or multi-chain.

The inclusion of epitopes specific for monoclonal antibodies in the extracellular domain of the CARs described herein allows sorting and depletion of engineered immune cells expressing the CARs. In some embodiments, this feature also promotes recovery of endogenous DLL3-expressing cells that were depleted by administration of engineered immune cells expressing the CARs. In some embodiments, allowing for depletion provides a safety switch in case of deleterious effects, e.g., upon administration to a subject.

Accordingly, in some embodiments, the present disclosure relates to a method for sorting and/or depleting the engineered immune cells endowed with the CARs comprising mAb-specific epitopes and a method for promoting recovery of endogenous DLL3-expressing cells.

Several epitope-monoclonal antibody couples can be used to generate CARs comprising monoclonal antibody specific epitopes; in particular, those already approved for medical use, such as CD20 epitope/rituximab as a non-limiting example.

The disclosure also encompasses methods for sorting the engineered immune cells endowed with the DLL3-specific CARs expressing the mAb-specific epitope(s) and therapeutic methods where the activation of the engineered immune cells endowed with these CARs is modulated by depleting the cells using an antibody that targets the external ligand binding domain of said CARs. Table 4 provides exemplary mimotope sequences that can be inserted into the extracellular domains of any one of the CARs of the disclosure.

TABLE 4

Exemplary mimotope sequences

Rituximab

| Mimotope | SEQ ID NO: 536 | CPYSNPSLC |

Palivizumab

| Epitope | SEQ ID NO: 537 | NSELLSLINDMPITNDQKKLMSNN |

Cetuximab

| Mimotope 1 | SEQ ID NO: 538 | CQFDLSTRRLKC |
| Mimotope 2 | SEQ ID NO: 539 | CQYNLSSRALKC |
| Mimotope 3 | SEQ ID NO: 540 | CVWQRWQKSYVC |
| Mimotope 4 | SEQ ID NO: 541 | CMWDRFSRWYKC |

Nivolumab

| Epitope 1 | SEQ ID NO: 542 | SFVLNWYRMSPSNQTDKLAAFPEDR |
| Epitope 2 | SEQ ID NO: 543 | SGTYLCGAISLAPKAQIKE |

QBEND-10

| Epitope | SEQ ID NO: 544 | ELPTQGTFSNVSTNVSPAKPTTTA |
|         | SEQ ID NO: 471 | ELPTQGTFSNVSTNVS |

Alemtuzumab

| Epitope | SEQ ID NO: 545 | GQNDTSQTSSPS |

In some embodiments, the extracellular binding domain of the CAR comprises the following sequence:

$V_1$-$L_1$-$V_2$-$(L)_x$-Epitope1-$(L)_x$-;

$V_1$-$L_1$-$V_2$-$(L)_x$-Epitope1-$(L)_x$-Epitope2-$(L)_x$-;

$V_1$-$L_1$-$V_2$-$(L)_x$-Epitope1-$(L)_x$-Epitope2-$(L)_x$-Epitope3-$(L)_x$-;

$(L)_x$-Epitope1-$(L)_x$-$V_1$-$L_1$-$V_2$;

$(L)_x$-Epitope1-$(L)_x$-Epitope2-$(L)_x$-$V_1$-$L_1$-$V_2$;

Epitope1-$(L)_x$-Epitope2-$(L)_x$-Epitope3-$(L)_x$-$V_1$-$L_1$-$V_2$;

$(L)_x$-Epitope1-$(L)_x$-$V_1$-$L_1$-$V_2$-$(L)_x$-Epitope2-$(L)_x$;

$(L)_x$-Epitope1-$(L)_x$-$V_1$-$L_1$-$V_2$-$(L)_x$-Epitope2-$(L)_x$-Epitope3-$(L)_x$-;

$(L)_x$-Epitope 1-$(L)_x$-$V_1$-$L_1$-$V_2$-$(L)_x$-Epitope2-$(L)_x$-Epitope3-$(L)_x$-Epitope4-$(L)_x$-;

$(L)_x$-Epitope1-$(L)_x$-Epitope2-$(L)_x$-$V_1$-$L_1$-$V_2$-$(L)_x$-Epitope3-$(L)_x$-;

$(L)_x$-Epitope1-$(L)_x$-Epitope2-$(L)_x$-$V_1$-$L_1$-$V_2$-$(L)_x$-Epitope3-$(L)_x$-Epitope4-$(L)_x$-;

$V_1$-$(L)_x$-Epitope1-$(L)_x$-$V_2$;

$V_1$-$(L)_x$-Epitope1-$(L)_x$-$V_2$-$(L)_x$-Epitope2-$(L)_x$;

$V_1$-$(L)_x$-Epitope1-$(L)_x$-$V_2$-$(L)_x$-Epitope2-$(L)_x$-Epitope3-$(L)_x$;

$V_1$-$(L)_x$-Epitope1-$(L)_x$-$V_2$-$(L)_x$-Epitope2-$(L)_x$-Epitope3-$(L)_x$-Epitope4-$(L)_x$;

$(L)_x$-Epitope1-$(L)_x$-$V_1$-$(L)_x$-Epitope2-$(L)_x$-$V_2$; or, $(L)_x$-Epitope1-$(L)_x$-$V_1$-$(L)_x$-Epitope2-$(L)_x$-$V_2$-$(L)_x$-Epitope3-$(L)_x$;

wherein, $V_1$ is VL and $V_2$ is VH or $V_1$ is VH and $V_2$ is VL $L_1$ is a linker suitable to link the VH chain to the VL chain;

Epitope 1, Epitope 2, Epitope 3 and Epitope 4 are mAb-specific epitopes and can be identical or c. Hinge Domain The extracellular domain of the CARs of the disclosure may comprise a "hinge" domain (or hinge region). The term generally to any polypeptide that functions to link the transmembrane domain in a CAR to the extracellular antigen binding domain in a CAR. In particular, hinge domains can be used to provide more flexibility and accessibility for the extracellular antigen binding domain.

A hinge domain may comprise up to 300 amino acids—in some embodiments 10 to 100 amino acids or in some embodiments 25 to 50 amino acids. The hinge domain may be derived from all or part of naturally occurring molecules, such as from all or part of the extracellular region of CD8, CD4, CD28, 4-1BB, or IgG (in particular, the hinge region of an IgG; it will be appreciated that the hinge region may contain some or all of a member of the immunoglobulin family such as IgG1, IgG2, IgG3, IgG4, IgA, IgD, IgE, IgM, or fragment thereof), or from all or part of an antibody heavy-chain constant region. Alternatively, the A domain may be a synthetic sequence that corresponds to a naturally occurring A sequence or may be an entirely synthetic A sequence. In some embodiments said A domain is a part of human CD8α chain (e.g., NP_001139345.1). In another particular embodiment, said hinge and transmembrane domains comprise a part of human CD8α chain. In some embodiments, the hinge domain of CARs described herein comprises a subsequence of CD8a, CD28, an IgG1, IgG4, PD-1 or an FcγRIIIα, in particular the hinge region of any of an CD8a, CD28, an IgG1, IgG4, PD-1 or an FcγRIIIα. In some embodiments, the hinge domain comprises a human CD8α hinge, a human IgG1 hinge, a human IgG4, a human PD-1 or a human FcγRIIIα hinge. In some embodiments the CARs disclosed herein comprise a scFv, CD8α human hinge and transmembrane domains, the CD3ζ signaling domain, and 4-1BB signaling domain. Table 5 provides amino acid sequences for exemplary hinges provided herein.

TABLE 5

Exemplary hinges

| Domain | Amino Acid Sequence | SEQ ID NO: |
|---|---|---|
| FcγRIIIα hinge | GLAVSTISSFFPPGYQ | 546 |
| CD8α hinge | TTTPAPRPPTPAPTIASQPLSLRPEACR-PAAGGAVHTRGLDFACD | 547 |
| IgG1 hinge | EPKSPDKTH-TCPPCPAPPVAGPSVFLFPPKPKDTLMIARTPEVTCVVVDVSHEDPE-VKFNWYVDGVEVHNAKTKPREEQYN-STYRVVSVLTVLHQDWLNGKEYKCKVSNKALPAPIEKTISKAKGQPREPQVYTLPPSRDELT-KNQVSLTCLVKGFYPSDIAVEWESNGQPEN-NYKTTPPVLDSDGSFFLYSKLTVDKSRWQQGNVFSCSVMHEALHN-HYTQKSLSLSPGK | 548 |

In certain embodiments, the hinge region comprises an amino acid sequence that is at least about 75%, at least about 80%, at least about 85%, at least about 90%, at least about 95%, at least about 96%, at least about 97%, at least about 98%, at least about 99%, or 100% identical to the extracellular domain amino acid sequences set forth herein in Table 5.

d. Transmembrane Domain

The CARs of the disclosure are designed with a transmembrane domain that is fused to the extracellular domain of the CAR. It can similarly be fused to the intracellular domain of the CAR. In some instances, the transmembrane domain can be selected or modified by amino acid substitution to avoid binding of such domains to the transmembrane domains of the same or different surface membrane proteins to minimize interactions with other members of the receptor complex. In some embodiments, short linkers may form linkages between any or some of the extracellular, transmembrane, and intracellular domains of the CAR.

Suitable transmembrane domains for a CAR disclosed herein have the ability to (a) be expressed at the surface an immune cell such as, for example without limitation, a lymphocyte cell, such as a T helper (T$_h$) cell, cytotoxic T (T$_c$) cell, T regulatory (T$_{reg}$) cell, or Natural killer (NK) cells, and/or (b) interact with the extracellular antigen binding domain and intracellular signaling domain for directing the cellular response of an immune cell against a target cell.

The transmembrane domain may be derived either from a natural or from a synthetic source. Where the source is natural, the domain may be derived from any membrane-bound or transmembrane protein.

Transmembrane regions of particular use in this disclosure may be derived from (comprise, or correspond to) CD28, OX-40, 4-1BB/CD137, CD2, CD7, CD27, CD30, CD40, programmed death-1 (PD-1), inducible T cell costimulator (ICOS), lymphocyte function-associated antigen-1 (LFA-1, CD1-1a/CD18), CD3 gamma, CD3 delta, CD3 epsilon, CD247, CD276 (B7-H3), LIGHT, (TNFSF14), NKG2C, Ig alpha (CD79a), DAP-10, Fc gamma receptor, MHC class 1 molecule, TNF receptor proteins, an Immunoglobulin protein, cytokine receptor, integrins, Signaling Lymphocytic Activation Molecules (SLAM proteins), activating NK cell receptors, BTLA, a Toll ligand receptors, ICAM-1, B7-H3, CDS, ICAM-1, GITR, BAFFR, LIGHT, HVEM (LIGHTR), KIRDS2, SLAMF7, NKp80 (KLRF1), NKp44, NKp30, NKp46, CD19, CD4, CD8alpha, CD8beta, IL-2R beta, IL-2R gamma, IL-7R alpha, ITGA4, VLA1, CD49a, ITGA4, IA4, CD49D, ITGA6, VLA-6, CD49f, ITGAD, CD1 1d, ITGAE, CD103, ITGAL, CD1 1a, LFA-1, ITGAM, CD1 1b, ITGAX, CD1 1c, ITGB1, CD29, ITGB2, CD18, LFA-1, ITGB7, NKG2D, TNFR2, TRANCE/RANKL, DNAM1 (CD226), SLAMF4 (CD244, 2B4), CD84, CD96 (Tactile), CEACAM1, CRT AM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, CD19a, a ligand that specifically binds with CD83, or any combination thereof.

As non-limiting examples, the transmembrane region can be a derived from, or be a portion of a T cell receptor such as α, β, γ or δ, polypeptide constituting CD3ζ complex, IL-2 receptor p55 (α chain), p75 (β chain) or γ chain, subunit chain of Fc receptors, in particular Fcγ receptor III or CD proteins. Alternatively, the transmembrane domain can be synthetic and can comprise predominantly hydrophobic residues such as leucine and valine. In some embodiments said transmembrane domain is derived from the human CD8α chain (e.g., NP_001139345.1).

In some embodiments, the transmembrane domain in the CAR of the disclosure is a CD8α transmembrane domain. In some embodiments, the transmembrane domain in the CAR of the disclosure is a CD8α transmembrane domain comprising the amino acid sequence IYIWAPLAGTCGVLLLSLVIT (SEQ ID NO: 549). In some embodiments, the CD8α transmembrane domain comprises the nucleic acid sequence that encodes the transmembrane amino acid sequence of SEQ ID NO: 549. In some embodiments, the hinge and transmembrane domain in the CAR of the disclosure is a CD8α hinge and transmembrane domain comprising the amino acid sequence of SEQ ID NO: 479.

In some embodiments, the transmembrane domain in the CAR of the disclosure is a CD28 transmembrane domain. In some embodiments, the transmembrane domain in the CAR of the disclosure is a CD28 transmembrane domain comprising the amino acid sequence of FWVLVVVGGVLA-CYSLLVTVAFIIFWV (SEQ ID NO: 550). In some embodiments, the CD28 transmembrane domain comprises the nucleic acid sequence that encodes the transmembrane amino acid sequence of SEQ ID NO: 550.

e. Intracellular Domain

The intracellular (cytoplasmic) domain of the CARs of the disclosure can provide activation of at least one of the normal effector functions of the immune cell comprising the CAR, e.g., Signal 1/activation and/or Signal 2/costimulation. Effector function of a T cell, for example, may refer to cytolytic activity or helper activity, including the secretion of cytokines. In some embodiments, an activating intracellular signaling domain for use in a CAR can be the cytoplasmic sequences of, for example without limitation, the T cell receptor and co-receptors that act in concert to initiate signal transduction following antigen receptor engagement, as well as any derivative or variant of these sequences and any synthetic sequence that has the same functional capability.

It will be appreciated that suitable (e.g., activating) intracellular domains include, but are not limited to signaling domains derived from (or corresponding to) CD3 zeta, CD28, OX-40, 4-1BB/CD137, CD2, CD7, CD27, CD30, CD40, programmed death-1 (PD-1), inducible T cell costimulator (ICOS), lymphocyte function-associated antigen-1 (LFA-1, CD1-1a/CD18), CD3 gamma, CD3 delta, CD3 epsilon, CD247, CD276 (B7-H3), LIGHT, (TNFSF14), NKG2C, Ig alpha (CD79a), DAP-10, Fc gamma receptor, MHC class 1 molecule, TNF receptor proteins, an Immunoglobulin protein, cytokine receptor, integrins, Signaling Lymphocytic Activation Molecules (SLAM proteins), activating NK cell receptors, BTLA, a Toll ligand receptors, ICAM-1, B7-H3, CDS, ICAM-1, GITR, BAFFR, LIGHT, HVEM (LIGHTR), KIRDS2, SLAMF7, NKp80 (KLRF1), NKp44, NKp30, NKp46, CD19, CD4, CD8alpha, CD8beta, IL-2R beta, IL-2R gamma, IL-7R alpha, ITGA4, VLA1, CD49a, ITGA4, IA4, CD49D, ITGA6, VLA-6, CD49f, ITGAD, CD1 1d, ITGAE, CD103, ITGAL, CD1 1a, LFA-1, ITGAM, CD1 1b, ITGAX, CD1 1c, ITGB1, CD29, ITGB2, CD18, LFA-1, ITGB7, NKG2D, TNFR2, TRANCE/ RANKL, DNAM1 (CD226), SLAMF4 (CD244, 2B4), CD84, CD96 (Tactile), CEACAM1, CRT AM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, CD19a, a ligand that specifically binds with CD83, or any combination thereof.

The intracellular domains of the CARs of the disclosure may incorporate, in addition to the activating domains described above, costimulatory signaling domains (interchangeably referred to herein as costimulatory molecules) to increase their potency. Costimulatory domains can provide a signal in addition to the primary signal provided by an activating molecule as described herein.

It will be appreciated that suitable costimulatory domains within the scope of the disclosure can be derived from (or correspond to) for example, CD28, OX40, 4-1BB/CD137, CD2, CD3 (alpha, beta, delta, epsilon, gamma, zeta), CD4, CD5, CD7, CD9, CD16, CD22, CD27, CD30, CD 33, CD37, CD40, CD 45, CD64, CD80, CD86, CD134, CD137, CD154, PD-1, ICOS, lymphocyte function-associated antigen-1 (LFA-1 (CD1 1a/CD18), CD247, CD276 (B7-H3), LIGHT (tumor necrosis factor superfamily member 14; TNFSF14), NKG2C, Ig alpha (CD79a), DAP-10, Fc gamma receptor, MHC class I molecule, TNFR, integrin, signaling lymphocytic activation molecule, BTLA, Toll ligand receptors, ICAM-1, B7-H3, CDS, ICAM-1, GITR, BAFFR, LIGHT, HVEM (LIGHTR), KIRDS2, SLAMF7, NKp80 (KLRF1), NKp44, NKp30, NKp46, CD19, CD4, CD8alpha, CD8beta, IL-2R beta, IL-2R gamma, IL-7R alpha, ITGA4, VLA1, CD49a, ITGA4, IA4, CD49D, ITGA6, VLA-6, CD49f, ITGAD, CD1-1d, ITGAE, CD103, ITGAL, CD1-1a, LFA-1, ITGAM, CD1-1b, ITGAX, CD1-1c, ITGB1, CD29, ITGB2, CD18, LFA-1, ITGB7, NKG2D, TNFR2, TRANCE/RANKL, DNAM1 (CD226), SLAMF4 (CD244, 2B4), CD84, CD96 (Tactile), CEACAM1, CRT AM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, CD19a, CD83 ligand, or fragments or combinations thereof. It will be appreciated that additional costimulatory molecules, or fragments thereof, not listed above are within the scope of the disclosure.

In some embodiments, the intracellular/cytoplasmic domain of the CAR can be designed to comprise the 41BB/CD137 domain by itself or combined with any other desired intracellular domain(s) useful in the context of the CAR of the disclosure. The complete native amino acid sequence of 41BB/CD137 is described in NCBI Reference Sequence: NP_001552.2. The complete native 41BB/CD137 nucleic acid sequence is described in NCBI Reference Sequence: NM_001561.5.

In some embodiments, the intracellular/cytoplasmic domain of the CAR can be designed to comprise the CD28 domain by itself or combined with any other desired intracellular domain(s) useful in the context of the CAR of the disclosure. The complete native amino acid sequence of CD28 is described in NCBI Reference Sequence: NP_006130.1. The complete native CD28 nucleic acid sequence is described in NCBI Reference Sequence: NM_006139.1.

In some embodiments, the intracellular/cytoplasmic domain of the CAR can be designed to comprise the CD3 zeta domain by itself or combined with any other desired intracellular domain(s) useful in the context of the CAR of the disclosure. In some embodiments, the intracellular signaling domain of the CAR can comprise the CD3 signaling domain which has amino acid sequence with at least about 70%, at least 80%, at least 90%, 95%, 97%, or 99% sequence identity with an amino acid sequence shown in SEQ ID NO: 481 in Table 7. For example, the intracellular domain of the CAR can comprise a CD3 zeta chain portion and a portion of a costimulatory signaling molecule. The intracellular signaling sequences within the intracellular signaling portion of the CAR of the disclosure may be linked to each other in a random or specified order. In some embodiments, the intracellular domain is designed to comprise the activating domain of CD3 zeta and a signaling domain of CD28. In some embodiments, the intracellular domain is designed to comprise the activating domain of CD3 zeta and a costimulatory/signaling domain of 4-1BB.

In some embodiments, the 4-1BB (intracellular domain) comprises the amino acid sequence KRGRKKLLY-IFKQPFMRPVQTTQEEDGCSCRFPEEEEGGCEL (SEQ ID NO: 480). In some embodiments, the 4-1BB (intracellular domain) is encoded by the nucleic acid sequence:

(SEQ ID NO: 568)
AAGCGCGGCAGGAAGAAGCTCCTCTACATTTTTAAGCAGCCTTTTATGA

GGCCCGTACAGACAACACAGGAGGAAGATGGCTGTAGCTGCAGATTTCC

CGAGGAGGAGGAAGGTGGGTGCGAGCTG

In some embodiments, the intracellular domain in the CAR is designed to comprise a portion of CD28 and CD3 zeta, wherein the intracellular CD28 comprises the nucleic acid sequence set forth in SEQ ID NO: 567.

(SEQ ID NO: 567)
AGATCCAAAAGAAGCCGCCTGCTCCATAGCGATTACATGAATATGACTC

CACGCCGCCCTGGCCCCACAAGGAAACACTACCAGCCTTACGCACCACC

TAGAGATTTCGCTGCCTATCGGAGC

In some embodiments, the intracellular domain in the CAR is designed to comprise the amino acid sequence RSKRSRLLHSDYMNMTPRRPGPTRKHYQPYAPPRD-FAAYRS (SEQ ID NO: 551). The CD3 zeta amino acid sequence may comprise SEQ ID NO: 481 or 469 and the nucleic acid sequence may comprise SEQ ID NO: 569:

(SEQ ID NO: 569)
AGGGTGAAGTTTTCCAGATCTGCAGATGCACCAGCGTATCAGCAGGGCC

AGAACCAACTGTATAACGAGCTCAACCTGGGACGCAGGGAAGAGTATGA

CGTTTTGGACAAGCGCAGAGGACGGGACCCTGAGATGGGTGGCAAACCA

-continued

```
AGACGAAAAAACCCCCAGGAGGGTCTCTATAATGAGCTGCAGAAGGATA

AGATGGCTGAAGCCTATTCTGAAATAGGCATGAAAGGAGAGCGGAGAAG

GGGAAAAGGGCACGACGGTTTGTACCAGGGACTCAGCACTGCTACGAAG

GATACTTATGACGCTCTCCACATGCAAGCCCTGCCACCTAGG
```

In some embodiments the intracellular signaling domain of the CAR of the disclosure comprises a domain of a co-stimulatory molecule. In some embodiments, the intracellular signaling domain of a CAR of the disclosure comprises a part of co-stimulatory molecule selected from the group consisting of fragment of 4-1BB (GenBank: AAA53133) and CD28 (NP_006130.1). In some embodiments, the intracellular signaling domain of the CAR of the disclosure comprises amino acid sequence which comprises at least 70%, at least 80%, at least 90%, 95%, 97%, or 99% sequence identity with an amino acid sequence shown in SEQ ID NO: 480 and SEQ ID NO: 551. In some embodiments, the intracellular signaling domain of the CAR of the disclosure comprises amino acid sequence which comprises at least 70%, at least 80%, at least 90%, 95%, 97%, or 99% sequence identity with an amino acid sequence shown in SEQ ID NO: 480 and/or at least 70%, at least 80%, at least 90%, 95%, 97%, or 99% sequence identity with an amino acid sequence shown in SEQ ID NO: 551.

In exemplary embodiments, a CAR of the disclosure comprises, from N-terminus to C-terminus: a (cleavable) CD8α signal sequence, a DLL3 scFv, a CD8α hinge and transmembrane region, a 4-1BB cytoplasmic (costimulatory) signaling domain, and a CD3ζ cytoplasmic (stimulatory) signaling domain.

III. Immune Cells Comprising CARs a. Immune Cells

Provided herein are engineered immune cells expressing the CARs of the disclosure (e.g., CAR-T cells).

In some embodiments, an engineered immune cell comprises a population of CARs, each CAR comprising different extracellular antigen-binding domains. In some embodiments, an immune cell comprises a population of CARs, each CAR comprising the same extracellular antigen-binding domains.

The engineered immune cells can be allogeneic or autologous.

In some embodiments, the engineered immune cell is a T cell (e.g., inflammatory T lymphocyte, cytotoxic T lymphocyte, regulatory T lymphocyte (Treg), helper T lymphocyte, tumor infiltrating lymphocyte (TIL)), natural killer T cell (NKT), TCR-expressing cell, dendritic cell, killer dendritic cell, a mast cell, or a B-cell. In some embodiments, the cell can be derived from the group consisting of CD4+T-lymphocytes and CD8+T-lymphocytes. In some exemplary embodiments, the engineered immune cell is a T cell. In some exemplary embodiments, the engineered immune cell is a gamma delta T cell. In some exemplary embodiments, the engineered immune cell is a macrophage. In some exemplary embodiments, the engineered immune cell is a natural killer (NK) cell.

In some embodiments, the engineered immune cell can be derived from, for example without limitation, a stem cell. The stem cells can be adult stem cells, non-human embryonic stem cells, more particularly non-human stem cells, cord blood stem cells, progenitor cells, bone marrow stem cells, induced pluripotent stem cells, totipotent stem cells or hematopoietic stem cells.

In some embodiments, the cell is obtained or prepared from peripheral blood. In some embodiments, the cell is obtained or prepared from peripheral blood mononuclear cells (PBMCs). In some embodiments, the cell is obtained or prepared from bone marrow. In some embodiments, the cell is obtained or prepared from umbilical cord blood. In some embodiments, the cell is a human cell.

In some embodiments, the cell is transfected or transduced by the nucleic acid vector using a method selected from the group consisting of electroporation, sonoporation, biolistics (e.g., Gene Gun), lipid transfection, polymer transfection, nanoparticles, viral transfection (e.g., retrovirus, lentivirus, AAV) or polyplexes.

In some embodiments, the engineered immune cells expressing at their cell surface membrane a DLL3-specific CAR of the disclosure comprise a percentage of stem cell memory and central memory cells greater than 10%, 20%, 30%, 40%, 50%, 60%, 70%, 80%, 90%, or 100%. In some embodiments, the engineered immune cells expressing at their cell surface membrane a DLL3-specific CAR of the disclosure comprise a percentage of stem cell memory and central memory cells of about 10% to about 100%, about 10% to about 90%, about 10% to about 80%, about 10% to about 70%, about 10% to about 60%, about 10% to about 50%, about 10% to about 40%, about 10% to about 30%, about 10% to about 20%, about 15% to about 100%, about 15% to about 90%, about 15% to about 80%, about 15% to about 70%, about 15% to about 60%, about 15% to about 50%, about 15% to about 40%, about 15% to about 30%, about 20% to about 100%, about 20% to about 90%, about 20% to about 80%, about 20% to about 70%, about 20% to about 60%, about 20% to about 50%, about 20% to about 40%, about 20% to about 30%, about 30% to about 100%, about 30% to about 90%, about 30% to about 80%, about 30% to about 70%, about 30% to about 60%, about 30% to about 50%, about 30% to about 40%, about 40% to about 100%, about 40% to about 90%, about 40% to about 80%, about 40% to about 70%, about 40% to about 60%, about 40% to about 50%, about 50% to about 100%, about 50% to about 90%, about 50% to about 80%, about 50% to about 70%, about 50% to about 60%, about 60% to about 100%, about 60% to about 90%, about 60% to about 80%, about 60% to about 70%, about 70% to about 90%, about 70% to about 80%, about 80% to about 100%, about 80% to about 90%, about 90% to about 100%, about 25% to about 50%, about 75% to about 100%, or about 50% to about 75%.

In some embodiments, the immune cell is an inflammatory T-lymphocyte that expresses any one of the CARs described herein. In some embodiments, the immune cell is a cytotoxic T-lymphocyte that expresses any one of the CARs described herein. In some embodiments, the immune cell is a regulatory T-lymphocyte that expresses any one of the CARs described herein. In some embodiments, the immune cell is a helper T-lymphocyte that expresses any one of the CARs described herein.

Prior to expansion and genetic modification, a source of cells can be obtained from a subject through a variety of non-limiting methods. Cells can be obtained from a number of non-limiting sources, including peripheral blood mononuclear cells, bone marrow, lymph node tissue, cord blood, thymus tissue, tissue from a site of infection, ascites, pleural effusion, spleen tissue, and tumors. In some embodiments, any number of T cell lines available and known to those skilled in the art, may be used. In some embodiments, cells can be derived from a healthy donor, from a patient diagnosed with cancer or from a patient diagnosed with an infection. In some embodiments, cells can be part of a mixed population of cells which present different phenotypic characteristics.

Also provided herein are cell lines obtained from a transformed immune cell (e.g., T-cell) according to any of the above-described methods. Also provided herein are modified cells resistant to an immunosuppressive treatment. In some embodiments, an isolated cell according to the disclosure comprises a polynucleotide encoding a CAR.

The immune cells of the disclosure can be activated and expanded, either prior to or after genetic modification of the immune cells, using methods as generally known. Generally, the engineered immune cells of the disclosure can be expanded, for example, by contacting with an agent that stimulates a CD3 TCR complex and a costimulatory molecule on the surface of the T-cells to create an activation signal for the T cell. For example, chemicals such as calcium ionophore A23187, phorbol 12-myristate 13-acetate (PMA), or mitogenic lectins like phytohemagglutinin (PHA) can be used to create an activation signal for the T cell.

In some embodiments, T cell populations may be stimulated in vitro by contact with, for example, an anti-CD3 antibody such as an OKT3 antibody, or antigen-binding fragment thereof, or an anti-CD2 antibody immobilized on a surface, or by contact with a protein kinase C activator (e.g., bryostatin) in conjunction with a calcium ionophore. For co-stimulation of an accessory molecule on the surface of the T cells, a ligand that binds the accessory molecule is used. For example, a population of T cells can be contacted with an anti-CD3 antibody (e.g., an OKT3 antibody) and an anti-CD28 antibody, under conditions appropriate for stimulating proliferation of the T cells. The anti-CD3 antibody and an anti-CD28 antibody can be disposed on a bead, such as a plastic or magnetic bead, or plate or other substrate. Conditions appropriate for T cell culture include an appropriate media (e.g., Minimal Essential Media or RPMI Media 1640 or, X-vivo 15, (Lonza)) that may contain factors necessary for proliferation and viability, including serum (e.g., fetal bovine or human serum), interleukin-2 (IL-2), insulin, IFN-γ, IL-4, IL-7, GM-CSF, IL-10, IL-2, IL-15, TGFbeta, and TNF, or any other additives for the growth of cells known to the skilled artisan. Other additives for the growth of cells include, but are not limited to, surfactant, plasmanate, and reducing agents such as N-acetyl-cysteine and 2-mercaptoethanoi. Media can include RPMI 1640, A1M-V, DMEM, MEM, a-MEM, F-12, X-Vivo 15, and X-Vivo 20, Optimizer, with added amino acids, sodium pyruvate, and vitamins, either serum-free or supplemented with an appropriate amount of serum (or plasma) or a defined set of hormones, and/or an amount of cytokine(s) sufficient for the growth and expansion of T cells (e.g., IL-7 and/or IL-15). Antibiotics, e.g., penicillin and streptomycin, are included only in experimental cultures, not in cultures of cells that are to be infused into a subject. The target cells are maintained under conditions necessary to support growth, for example, an appropriate temperature (e.g., 37° C.) and atmosphere (e.g., air plus 5% $CO_2$). T cells that have been exposed to varied stimulation times may exhibit different characteristics. In some embodiments, the cells of the disclosure can be expanded by co-culturing with tissue or cells. The cells can also be expanded in vivo, for example in the subject's blood after administering the cell into the subject.

In some embodiments, an engineered immune cell according to the present disclosure may comprise one or more disrupted or inactivated genes. In some embodiments, an engineered immune cell according to the present disclosure comprises one disrupted or inactivated gene selected from the group consisting of CD52, DLL3, GR, PD-1, CTLA-4, LAG3, TIM3, BTLA, BY55, TIGIT, B7H5, LAIR1, SIGLEC10, 2B4, HLA, TCRα and TCRβ and/or expresses a CAR, a multi-chain CAR and/or a pTa transgene. In some embodiments, an isolated cell comprises polynucleotides encoding polypeptides comprising a multi-chain CAR. In some embodiments, the isolated cell according to the present disclosure comprises two disrupted or inactivated genes selected from the group consisting of: CD52 and GR, CD52 and TCRα, CDR52 and TCRβ, DLL3 and CD52, DLL3 and TCRα, DLL3 and TCRβ, GR and TCRα, GR and TCRβ, TCRα and TCRβ, PD-1 and TCRα, PD-1 and TCRβ, CTLA-4 and TCRα, CTLA-4 and TCRβ, LAG3 and TCRα, LAG3 and TCRβ, TIM3 and TCRα, Tim3 and TCRβ, BTLA and TCRα, BTLA and TCRβ, BY55 and TCRα, BY55 and TCRβ, TIGIT and TCRα, TIGIT and TCRβ, B7H5 and TCRα, B7H5 and TCRβ, LAIR1 and TCRα, LAIR1 and TCRβ, SIGLEC10 and TCRα, SIGLEC10 and TCRβ, 2B4 and TCRα, 2B4 and TCRβ and/or expresses a CAR, a multi-chain CAR and a pTa transgene. In some embodiments the method comprises disrupting or inactivating one or more genes by introducing into the cells a endonuclease able to selectively inactivate a gene by selective DNA cleavage. In some embodiments the endonuclease can be, for example, a zinc finger nuclease (ZFN), megaTAL nuclease, meganuclease, transcription activator-like effector nuclease (TALE-nuclease/TALEN), or CRISPR (e.g., Cas9) endonuclease.

In some embodiments, TCR is rendered not functional in the cells according to the disclosure by disrupting or inactivating TCRα gene and/or TCRβ gene(s). In some embodiments, a method to obtain modified cells derived from an individual is provided, wherein the cells can proliferate independently of the major histocompatibility complex (MHC) signaling pathway. Modified cells, which can proliferate independently of the MHC signaling pathway, susceptible to be obtained by this method are encompassed in the scope of the present disclosure. Modified cells disclosed herein can be used in for treating patients in need thereof against Host versus Graft (HvG) rejection and Graft versus Host Disease (GvHD); therefore in the scope of the present disclosure is a method of treating patients in need thereof against Host versus Graft (HvG) rejection and Graft versus Host Disease (GvHD) comprising treating said patient by administering to said patient an effective amount of modified cells comprising disrupted or inactivated TCRα and/or TCRβ genes.

In some embodiments, the immune cells are engineered to be resistant to one or more chemotherapy drugs. The chemotherapy drug can be, for example, a purine nucleotide analogue (PNA), thus making the immune cell suitable for cancer treatment combining adoptive immunotherapy and chemotherapy. Exemplary PNAs include, for example, clofarabine, fludarabine, cyclophosphamide, and cytarabine, alone or in combination. PNAs are metabolized by deoxycytidine kinase (dCK) into mono-, di-, and tri-phosphate PNA. Their tri-phosphate forms compete with ATP for DNA synthesis, act as pro-apoptotic agents, and are potent inhibitors of ribonucleotide reductase (RNR), which is involved in trinucleotide production. Provided herein are DLL3-specific CAR-T cells comprising a disrupted or inactivated dCK gene. In some embodiments, the dCK knockout cells are made by transfection of T cells using polynucleotides encoding specific TAL-nuclease directed against dCK genes by, for example, electroporation of mRNA. The dCK knockout DLL3-specific CAR-T cells are resistant to PNAs, including for example clorofarabine and/or fludarabine, and maintain T cell cytotoxic activity toward DLL3-expressing cells.

In some embodiments, isolated cells or cell lines of the disclosure can comprise a pTα or a functional variant thereof. In some embodiments, an isolated cell or cell line can be further genetically modified by disrupting or inactivating the TCRα gene.

The disclosure also provides engineered immune cells comprising any of the CAR polynucleotides described herein. In some embodiments, a CAR can be introduced into an immune cell as a transgene via a plasmid vector. In some embodiments, the plasmid vector can also contain, for example, a selection marker which provides for identification and/or selection of cells which received the vector.

CAR polypeptides may be synthesized in situ in the cell after introduction of polynucleotides encoding the CAR polypeptides into the cell. Alternatively, CAR polypeptides may be produced outside of cells, and then introduced into cells. Methods for introducing a polynucleotide construct into cells are known in the art. In some embodiments, stable transformation methods (e.g., using a lentiviral vector) can be used to integrate the polynucleotide construct into the genome of the cell. In other embodiments, transient transformation methods can be used to transiently express the polynucleotide construct, and the polynucleotide construct not integrated into the genome of the cell. In other embodiments, virus-mediated methods can be used. The polynucleotides may be introduced into a cell by any suitable means such as for example, recombinant viral vectors (e.g., retroviruses, adenoviruses), liposomes, and the like. Transient transformation methods include, for example without limitation, microinjection, electroporation or particle bombardment. Polynucleotides may be included in vectors, such as for example plasmid vectors or viral vectors.

In some embodiments, isolated nucleic acids are provided comprising a promoter operably linked to a first polynucleotide encoding a DLL3 antigen binding domain, at least one costimulatory molecule, and an activating domain. In some embodiments, the nucleic acid construct is contained within a viral vector. In some embodiments, the viral vector is selected from the group consisting of retroviral vectors, murine leukemia virus vectors, SFG vectors, adenoviral vectors, lentiviral vectors, adeno-associated virus (AAV) vectors, Herpes virus vectors, and vaccinia virus vectors. In some embodiments, the nucleic acid is contained within a plasmid.

b. Methods of Making

Provided herein are methods of making the CARs and the CAR-containing immune cells of the disclosure.

A variety of known techniques can be utilized in making the polynucleotides, polypeptides, vectors, antigen binding domains, immune cells, compositions, and the like according to the disclosure.

Prior to the in vitro manipulation or genetic modification of the immune cells described herein, the cells may be obtained from a subject. The cells expressing a DLL3 CAR may be derived from an allogenic or autologous process.

i. Source Material

In some embodiments, the immune cells comprise T cells. T cells can be obtained from a number of sources, including peripheral blood mononuclear cells (PBMCs), bone marrow, lymph nodes tissue, cord blood, thymus tissue, tissue from a site of infection, ascites, pleural effusion, spleen tissue, and tumors. In certain embodiments, T cells can be obtained from a unit of blood collected from the subject using any number of techniques known to the skilled person, such as FICOLL™ separation.

Cells may be obtained from the circulating blood of an individual by apheresis. The apheresis product typically contains lymphocytes, including T cells, monocytes, granulocytes, B cells, other nucleated white blood cells, red blood cells, and platelets. In certain embodiments, the cells collected by apheresis may be washed to remove the plasma fraction, and placed in an appropriate buffer or media for subsequent processing.

In certain embodiments, T cells are isolated from PBMCs by lysing the red blood cells and depleting the monocytes, for example, using centrifugation through a PERCOLL™ gradient. A specific subpopulation of T cells, (e.g., CD28+, CD4+, CDS+, CD45RA−, CD45RO+, CDS+, CD62−, CD95−, CD95+, IL2RP+, IL2Rβ−, CCR7+, CCR7−, CDL−, CD62L+ and combinations thereof) can be further isolated by positive or negative selection techniques known in the art. In one example the subpopulation of T cells is CD45RA+, CD95−, IL-2Rβ−, CCR7+, CD62L+. In one example the subpopulation of T cells is CD45RA+, CD95+, IL-2Rβ+, CCR7+, CD62L+. In one example the subpopulation of T cells is CD45RO+, CD95+, IL-2Rβ+, CCR7+, CD62L+. In one example the subpopulation of T cells is CD45RO+, CD95+, IL-2Rβ+, CCR7−, CD62L−. In one example the subpopulation of T cells is CD45RA+, CD95+, IL-2Rβ+, CCR7−, CD62L−. For example, enrichment of a T cell population by negative selection can be accomplished with a combination of antibodies directed to surface markers unique to the negatively selected cells. One method for use herein is cell sorting and/or selection via negative magnetic immunoadherence or flow cytometry that uses a cocktail of monoclonal antibodies directed to cell surface markers present on the cells negatively selected. For example, to enrich for CD4+ cells by negative selection, a monoclonal antibody cocktail typically includes antibodies to CD14, CD20, CD11b, CD16, HLA-DR, and CD8. Flow cytometry and cell sorting may also be used to isolate cell populations of interest for use in the present disclosure.

PBMCs may be used directly for genetic modification with the immune cells (such as CARs or TCRs) using methods as described herein. In certain embodiments, after isolating the PBMCs, T lymphocytes can be further isolated and both cytotoxic and helper T lymphocytes can be sorted into naïve, memory, and effector T cell subpopulations either before or after genetic modification and/or expansion.

In some embodiments, CD8+ cells are further sorted into naïve, stem cell memory, central memory, and effector cells by identifying characteristic cell surface antigens that are associated with each of these types of CD8+ cells. In some embodiments, the expression of phenotypic markers of central memory T cells include CD45RO, CD62L, CCR7, CD28, CD3, and CD127 and are negative for granzyme B. In some embodiments, stem cell memory T cells are CD45RO−, CD62L+, CD8+ T cells. In some embodiments, central memory T cells are CD45RO+, CD62L+, CD8+ T cells. In some embodiments, effector T cells are negative for CD62L, CCR7, CD28, and CD127, and positive for granzyme B and perforin.

In certain embodiments, CD4+ T cells are further sorted into subpopulations. For example, CD4+T helper cells can be sorted into naïve, central memory, and effector cells by identifying cell populations that have characteristic cell surface antigens.

iii. Stem Cell-Derived Immune Cells

In some embodiments, the immune cells may be derived from stem cells, such as a progenitor cell, a bone barrow stem cell, an inducible pluripotent stem cell, an iPSC, a hematopoietic stem cell, and a mesenchymal stem cell. iPS cells and other types of stem cells may be cultivated immortal cell lines or isolated directly from a patient. Various methods for isolating, developing, and/or cultivating stem cells are known in the art and may be used to practice the present invention.

In some embodiments, the immune cell is an induced pluripotent stem cell (iPSC) derived from a reprogrammed T-cell. In some embodiments, the source material may be an induced pluripotent stem cell (iPSC) derived from a T cell or non-T cell. The source material may alternatively be a B cell, or any other cell from peripheral blood mononuclear cell isolates, hematopoietic progenitor, hematopoietic stem cell, mesenchymal stem cell, adipose stem cell, or any other somatic cell type.

ii. Genetic Modification of Isolated Cells

The immune cells, such as T cells, can be genetically modified following isolation using known methods, or the immune cells can be activated and expanded (or differentiated in the case of progenitors) in vitro prior to being genetically modified. In some embodiments, the isolated immune cells are genetically modified to reduce or eliminate expression of endogenous TCRα and/or CD52. In some embodiments, the cells are genetically modified using gene editing technology (e.g., CRISPR/Cas9, CRISPR/CAS12, a zinc finger nuclease (ZFN), a TALEN, a MegaTAL, a meganuclease) to reduce or eliminate expression of endogenous proteins (e.g., TCRα and/or CD52). In another embodiment, the immune cells, such as T cells, are optionally further genetically modified with the chimeric antigen receptors described herein (e.g., transduced with a viral vector comprising one or more nucleotide sequences encoding a CAR) and then are activated and/or expanded in vitro.

Methods for activating and expanding T cells are known in the art and are described, for example, in U.S. Pat. Nos. 6,905,874; 6,867,041; 6,797,514; and PCT WO2012/079000, the contents of which are hereby incorporated by reference in their entirety. Generally, such methods include contacting PBMC or isolated T cells with a stimulatory molecule and a costimulatory molecule, such as anti-CD3 and anti-CD28 antibodies, generally attached to a plastic or magnetic bead or other surface, in a culture medium with appropriate cytokines, such as IL-2. Anti-CD3 and anti-CD28 antibodies attached to the same bead serve as a "surrogate" antigen presenting cell (APC). One example is the Dynabeads® system, which is a CD3/CD28 activator/stimulator system for physiological activation of human T cells. In other embodiments, the T cells may be activated and stimulated to proliferate with feeder cells and appropriate antibodies and cytokines using methods such as those described in U.S. Pat. Nos. 6,040,177; 5,827,642; and WO2012129514, the contents of which are hereby incorporated by reference in their entirety.

Certain methods for making the constructs and engineered immune cells of the disclosure are described in PCT application PCT/US15/14520, the contents of which are hereby incorporated by reference in their entirety.

It will be appreciated that PBMCs can further include other cytotoxic lymphocytes such as NK cells or NKT cells. An expression vector carrying the coding sequence of a chimeric receptor as disclosed herein can be introduced into a population of human donor T cells, NK cells or NKT cells. Successfully transduced T cells that carry the expression vector can be sorted using flow cytometry to isolate CD3 positive T cells and then further propagated to increase the number of these CAR expressing T cells in addition to cell activation using anti-CD3 antibodies and IL-2 or other methods known in the art as described elsewhere herein.

Standard procedures are used for cryopreservation of T cells expressing the CAR for storage and/or preparation for use in a human subject. In one embodiment, the in vitro transduction, culture and/or expansion of T cells are performed in the absence of non-human animal derived products such as fetal calf serum and fetal bovine serum. In an embodiment, cryopreservation can comprise freezing in a suitable medium, such as CryoStor® CS10, CryoStor® CS2 or CryoStor® CS5 (BioLife Solutions).

For cloning of polynucleotides, the vector may be introduced into a host cell (an isolated host cell) to allow replication of the vector itself and thereby amplify the copies of the polynucleotide contained therein. The cloning vectors may contain sequence components generally include, without limitation, an origin of replication, promoter sequences, transcription initiation sequences, enhancer sequences, and selectable markers. These elements may be selected as appropriate by a person of ordinary skill in the art. For example, the origin of replication may be selected to promote autonomous replication of the vector in the host cell.

In certain embodiments, the present disclosure provides isolated host cells containing the vector provided herein. The host cells containing the vector may be useful in expression or cloning of the polynucleotide contained in the vector. Suitable host cells can include, without limitation, prokaryotic cells, fungal cells, yeast cells, or higher eukaryotic cells such as mammalian cells, and more specifically human cells.

The vector can be introduced to the host cell using any suitable methods known in the art, including, without limitation, DEAE-dextran mediated delivery, calcium phosphate precipitate method, cationic lipids mediated delivery, liposome mediated transfection, electroporation, microprojectile bombardment, receptor-mediated gene delivery, delivery mediated by polylysine, histone, chitosan, and peptides. Standard methods for viral transfection and transformation of cells for expression of a vector of interest are well known in the art. In a further embodiment, a mixture of different expression vectors can be used in genetically modifying a donor population of immune effector cells wherein each vector encodes a different CAR as disclosed herein. The resulting transduced immune effector cells form a mixed population of engineered cells, with a proportion of the engineered cells expressing more than one different CARs.

In one embodiment, the disclosure provides a method of storing genetically engineered cells expressing CARs which target a DLL3 protein. In an embodiment this involves cryopreserving the immune cells such that the cells remain viable upon thawing. In an embodiment, cryopreservation can comprise freezing in a suitable medium, such as CryoStor® CS10, CryoStor® CS2 or CryoStor® CS5 (BioLife Solutions). A fraction of the immune cells expressing the CARs can be cryopreserved by methods known in the art to provide a permanent source of such cells for the future treatment of patients afflicted with a malignancy. When needed, the cryopreserved transformed immune cells can be thawed, grown and expanded for more such cells.

In some embodiments, the cells are formulated by first harvesting them from their culture medium, and then washing and concentrating the cells in a medium and container system suitable for administration (a "pharmaceutically acceptable" carrier) in a treatment-effective amount. Suitable infusion media can be any isotonic medium formulation, typically normal saline, Normosol™ R (Abbott) or Plasma-Lyte™ A (Baxter), but also 5% dextrose in water or Ringer's lactate can be utilized. The infusion medium can be supplemented with human serum albumin.

iv. Allogeneic CAR T Cells

In brief, the process for manufacturing allogeneic CAR T therapy, or AlloCARs™ involves harvesting healthy, selected, screened and tested T cells from healthy donors. Allogeneic T cells are gene editing to reduce the risk of graft versus host disease (GvHD) and to prevent allogeneic rejection. A selected T cell receptor gene (e.g., TCRα, TCRβ) is knocked out to avoid GvHD. The CD52 gene can also be knocked out to render the CAR T product resistant to anti-CD52 antibody treatment. Anti-CD52 antibody treatment can therefore be used to lymphodeplete the host immune system and allow the CAR T cells to stay engrafted to achieve full therapeutic impact. Next, the T cells are engineered to express CARs, which recognize certain cell surface proteins (e.g., DLL-3) that are expressed in hematologic or solid tumors. The engineered T cells then undergo a purification step and are ultimately cryopreserved in vials for delivery to patients.

v. Autologous CAR T cells

Autologous chimeric antigen receptor (CAR) T cell therapy, involves collecting a patient's own cells (e.g., white blood cells, including T cells) and genetically engineering the T cells to express CARs that recognize a target antigen expressed on the cell surface of one or more specific cancer cells and kill cancer cells. The engineered cells are then cryopreserved and subsequently administered to the patient from which the cells were removed for engineering.

IV. Methods of Treatment

The disclosure comprises methods for treating or preventing a condition associated with undesired and/or elevated DLL3 levels in a patient, comprising administering to a patient in need thereof an effective amount of at least one CAR, or immune-cell comprising a CAR disclosed herein.

Methods are provided for treating diseases or disorders, including cancer. In some embodiments, the disclosure relates to creating a T cell-mediated immune response in a subject, comprising administering an effective amount of the engineered immune cells of the present application to the subject. In some embodiments, the T cell-mediated immune response is directed against a target cell or cells. In some embodiments, the engineered immune cell comprises a chimeric antigen receptor (CAR). In some embodiments, the target cell is a tumor cell. In some aspects the disclosure comprises a method for treating or preventing a malignancy, said method comprising administering to a subject in need thereof an effective amount of at least one isolated antigen binding domain described herein. In some aspects, the disclosure comprises a method for treating or preventing a malignancy, said method comprising administering to a subject in need thereof an effective amount of at least one immune cell, wherein the immune cell comprises at least one chimeric antigen receptor, and/or isolated antigen binding domain as described herein. The CAR containing immune cells of the disclosure can be used to treat malignancies involving aberrant expression of DLL3. In some embodiments, CAR containing immune cells of the disclosure can be used to treat such malignancies as small cell lung cancer, melanoma, low grade gliomas, glioblastoma, medullary thyroid cancer, carcinoids, dispersed neuroendocrine tumors in the pancreas, bladder and prostate, testicular cancer, and lung adenocarcinomas with neuroendocrine features. In exemplary embodiments, the CAR-containing immune cells, e.g., the anti-DLL3 CAR-T cells of the disclosure, are used to treat small cell lung cancer.

Also provided are methods for reducing the size of a tumor in a subject, comprising administering to the subject an engineered cell of the present disclosure to the subject, wherein the cell comprises a chimeric antigen receptor comprising a DLL3 antigen binding domain and binds to a DLL3 antigen on the tumor.

In some embodiments, the subject has a solid tumor, or a blood malignancy such as lymphoma or leukemia. In some embodiments, the engineered cell is delivered to a tumor bed, such as a tumor bed found in small cell lung cancer. In some embodiments, the cancer is present in the bone marrow of the subject. In some embodiments, the engineered cells are autologous immune cells, e.g., autologous T cells. In some embodiments, the engineered cells are allogeneic immune cells, e.g., allogeneic T cells. In some embodiments, the engineered cells are heterologous immune cells, e.g., heterologous T cells. In some embodiments, the engineered cells are transfected or transduced ex vivo. As used herein, the term "in vitro cell" refers to any cell that is cultured ex vivo.

A "therapeutically effective amount," "effective dose," "effective amount," or "therapeutically effective dosage" of a therapeutic agent, e.g., engineered CART cells, is any amount that, when used alone or in combination with another therapeutic agent, protects a subject against the onset of a disease or promotes disease regression evidenced by a decrease in severity of disease symptoms, an increase in frequency and duration of disease symptom-free periods, or a prevention of impairment or disability due to the disease affliction. The ability of a therapeutic agent to promote disease regression can be evaluated using a variety of methods known to the skilled practitioner (e.g., a physician or clinician), such as in human subjects during clinical trials, in animal model systems predictive of efficacy in humans, or by assaying the activity of the agent in in vitro assays.

The terms "patient" and "subject" are used interchangeably and include human and non-human animal subjects as well as those with formally diagnosed disorders, those without formally recognized disorders, those receiving medical attention, those at risk of developing the disorders, etc.

The term "treat" and "treatment" includes therapeutic treatments, prophylactic treatments, and applications in which one reduces the risk that a subject will develop a disorder or other risk factor. Treatment does not require the complete curing of a disorder and encompasses embodiments in which one reduces symptoms or underlying risk factors. The term "prevent" does not require the 100% elimination of the possibility of an event. Rather, it denotes that the likelihood of the occurrence of the event has been reduced in the presence of the compound or method.

Desired treatment total amounts of cells in the composition comprise at least 2 cells (for example, at least one CD8+ T cell and at least one CD4+ T cell, or two CD8+ T cells, or two CD4+ T cells) or is more typically greater than $10^2$ cells, and up to $10^6$, up to and including $10^8$ or $10^9$ cells and can be $10^{10}$ or $10^{12}$ or more cells. The number of cells will depend upon the desired use for which the composition is intended, and the type of cells included therein. The density of the desired cells is typically greater than $10^6$ cells/ml and generally is greater than $10^7$ cells/ml, generally $10^8$ cells/ml or greater. The clinically relevant number of immune cells can be apportioned into multiple infusions that cumulatively equal or exceed $10^5$, $10^6$, $10^7$, $10^8$, $10^9$, $10^{10}$, $10^{11}$, or $10^{12}$ cells. In some aspects of the present disclosure, particularly since all the infused cells will be redirected to a particular target antigen (e.g., DLL3), lower numbers of cells, in the range of $10^6$/kilogram ($10^6$-$10^{11}$ per patient) may be administered. CAR treatments may be administered multiple times at dosages within these ranges. The cells may be autologous, allogeneic, or heterologous to the patient undergoing therapy.

In some embodiments, the therapeutically effective amount of the CAR T cells is about $1 \times 10^5$ cells/kg, about $2 \times 10^5$ cells/kg, about $3 \times 10^5$ cells/kg, about $4 \times 10^5$ cells/kg, about $5 \times 10^5$ cells/kg, about $6 \times 10^5$ cells/kg, about $7 \times 10^5$ cells/kg, about $8 \times 10^5$ cells/kg, about $9 \times 10^5$ cells/kg, $2 \times 10^6$ cells/kg, about $3 \times 10^6$ cells/kg, about $4 \times 10^6$ cells/kg, about $5 \times 10^6$ cells/kg, about $6 \times 10^6$ cells/kg, about $7 \times 10^6$ cells/kg, about $8 \times 10^6$ cells/kg, about $9 \times 10^6$ cells/kg, about $1 \times 10^7$ cells/kg, about $2 \times 10^7$ cells/kg, about $3 \times 10^7$ cells/kg, about $4 \times 10^7$ cells/kg, about $5 \times 10^7$ cells/kg, about $6 \times 10^7$ cells/kg, about $7 \times 10^7$ cells/kg, about $8 \times 10^7$ cells/kg, or about $9 \times 10^7$ cells/kg.

In some embodiments, target doses for CAR+/CAR-T+ cells range from about $1 \times 10^6$ to about $1 \times 10^{10}$ cells/kg, for example about $1 \times 10^6$ cells/kg, about $1 \times 10^7$ cells/kg, about $1 \times 10^8$ cells/kg, about $1 \times 10^9$ cells/kg or about $1 \times 10^{10}$ cells/kg. It will be appreciated that doses above and below this range may be appropriate for certain subjects, and appropriate dose levels can be determined by the healthcare provider as needed. Additionally, multiple doses of cells can be provided in accordance with the disclosure.

In some aspects the disclosure comprises a pharmaceutical composition comprising at least one antigen binding domain as described herein and a pharmaceutically acceptable excipient. In some embodiments, the pharmaceutical composition further comprises an additional active agent.

The CAR expressing cell populations of the present disclosure may be administered either alone, or as a pharmaceutical composition in combination with diluents and/or with other components such as IL-2 or other cytokines or cell populations. Pharmaceutical compositions of the present disclosure may comprise a CAR expressing cell population, such as T cells, as described herein, in combination with one or more pharmaceutically or physiologically acceptable carriers, diluents or excipients. Such compositions may comprise buffers such as neutral buffered saline, phosphate buffered saline and the like; carbohydrates such as glucose, mannose, sucrose or dextrans, mannitol; proteins; polypeptides or amino acids such as glycine; antioxidants; chelating agents such as EDTA or glutathione; adjuvants (e.g., aluminum hydroxide); and preservatives. Compositions of the present disclosure are preferably formulated for intravenous administration.

The pharmaceutical compositions (solutions, suspensions or the like), may include one or more of the following: sterile diluents such as water for injection, saline solution, preferably physiological saline, Ringer's solution, isotonic sodium chloride, fixed oils such as synthetic mono- or diglycerides which may serve as the solvent or suspending medium, polyethylene glycols, glycerin, propylene glycol or other solvents; antibacterial agents such as benzyl alcohol or methyl paraben; antioxidants such as ascorbic acid or sodium bisulfite; chelating agents such as ethylenediaminetetraacetic acid; buffers such as acetates, citrates or phosphates and agents for the adjustment of tonicity such as sodium chloride or dextrose. The parenteral preparation can be enclosed in ampoules, disposable syringes or multiple dose vials made of glass or plastic. For therapeutic applications, an injectable pharmaceutical composition is preferably sterile.

In some embodiments, upon administration to a patient, engineered immune cells expressing at their cell surface any one of the DLL3-specific CARs described herein may reduce, kill or lyse endogenous DLL3-expressing cells of the patient. In one embodiment, a percentage reduction or lysis of DLL3-expressing endogenous cells or cells of a cell line expressing DLL3 by engineered immune cells expressing any one of the DLL3-specific CARs described herein is at least about or greater than 10%, 15%, 20%, 25%, 30%, 35%, 40%, 45%, 50%, 55%, 60%, 65%, 70%, 75%, 80%, 85%, 90%, or 95%. In one embodiment, a percentage reduction or lysis of DLL3-expressing endogenous cells or cells of a cell line expressing DLL3 by engineered immune cells expressing any one of the DLL3-specific CARs described herein is about 5% to about 95%, about 10% to about 95%, about 10% to about 90%, about 10% to about 80%, about 10% to about 70%, about 10% to about 60%, about 10% to about 50%, about 10% to about 40%, about 20% to about 90%, about 20% to about 80%, about 20% to about 70%, about 20% to about 60%, about 20% to about 50%, about 25% to about 75%, or about 25% to about 60%. In one embodiment, the endogenous DLL3-expressing cells are endogenous DLL3-expressing bone marrow cells.

In one embodiment, the percent reduction or lysis of target cells, e.g., a cell line expressing DLL3, by engineered immune cells expressing at their cell surface membrane a DLL3-specific CAR of the disclosure can be measured using the assay disclosed herein.

The methods can further comprise administering one or more chemotherapeutic agents to a patient prior to administering the engineered cells provided herein. In certain embodiments, the chemotherapeutic agent is a lymphodepleting (preconditioning) chemotherapeutic. For example, methods of conditioning a patient in need of a T cell therapy comprising administering to the patient specified beneficial doses of cyclophosphamide (between 200 mg/m$^2$/day and 2000 mg/m$^2$/day, about 100 mg/m$^2$/day and about 2000 mg/m$^2$/day; e.g., about 100 mg/m$^2$/day, about 200 mg/m$^2$/day, about 300 mg/m$^2$/day, about 400 mg/m$^2$/day, about 500 mg/m$^2$/day, about 600 mg/m$^2$/day, about 700 mg/m$^2$/day, about 800 mg/m$^2$/day, about 900 mg/m$^2$/day, about 1000 mg/m$^2$/day, about 1500 mg/m$^2$/day or about 2000 mg/m$^2$/day) and specified doses of fludarabine (between 20 mg/m$^2$/day and 900 mg/m$^2$/day, between about 10 mg/m$^2$/day and about 900 mg/m$^2$/day; e.g., about 10 mg/m$^2$/day, about 20 mg/m$^2$/day, about 30 mg/m$^2$/day, about 40 mg/m$^2$/day, about 40 mg/m$^2$/day, about 50 mg/m$^2$/day, about 60 mg/m$^2$/day, about 70 mg/m$^2$/day, about 80 mg/m$^2$/day, about 90 mg/m$^2$/day, about 100 mg/m$^2$/day, about 500 mg/m$^2$/day or about 900 mg/m$^2$/day). An exemplary dosing regimen involves treating a patient comprising administering daily to the patient about 300 mg/m$^2$/day of cyclophosphamide in combination or before or after administering about 30 mg/m$^2$/day of fludarabine for three days prior to administration of a therapeutically effective amount of engineered T cells to the patient.

In some embodiments, notably in the case when the engineered cells provided herein have been gene edited to eliminate or minimize surface expression of CD52, lymphodepletion further comprises administration of an anti-CD52 antibody, such as alemtuzumab. In some embodiments, the CD52 antibody is administered at a dose of about 1-20 mg/day IV, e.g., about 13 mg/day IV for 1, 2, 3 or more days. The antibody can be administered in combination with, before, or after administration of other elements of a lymphodepletion regime (e.g., cyclophosphamide and/or fludarabine).

In other embodiments, the antigen binding domain, transduced (or otherwise engineered) cells and the chemotherapeutic agent are administered each in an amount effective to treat the disease or condition in the subject.

In certain embodiments, compositions comprising CAR-expressing immune effector cells disclosed herein may be administered in conjunction with any number of chemotherapeutic agents. Examples of chemotherapeutic agents include alkylating agents such as thiotepa and cyclophosphamide (CYTOXAN™); alkyl sulfonates such as busulfan, improsulfan and piposulfan; aziridines such as benzodopa, carboquone, meturedopa, and uredopa; ethylenimines and methylamelamines including altretamine, triethylenemelamine, trietylenephosphoramide, triethylenethiophosphaoramide and trimethylolomelamine resume; nitrogen mustards such as chlorambucil, chlornaphazine, cholophosphamide, estramustine, ifosfamide, mechlorethamine, mechlorethamine oxide hydrochloride, melphalan, novembichin, phenesterine, prednimustine, trofosfamide, uracil mustard; nitrosureas such as carmustine, chlorozotocin, fotemustine, lomustine, nimustine, ranimustine; antibiotics such as aclacinomysins, actinomycin, authramycin, azaserine, bleomycins, cactinomycin, calicheamicin, carabicin, carminomycin, carzinophilin, chromomycins, dactinomycin, daunorubicin, detorubicin, 6-diazo-5-oxo-L-norleucine, doxorubicin, epirubicin, esorubicin, idarubicin, marcellomycin, mitomycins, mycophenolic acid, nogalamycin, olivomycins, peplomycin, potfiromycin, puromycin, quelamycin, rodorubicin, streptonigrin, streptozocin, tubercidin, ubenimex, zinostatin, zorubicin; anti-metabolites such as methotrexate and 5-fluorouracil (5-FU); folic acid analogues such as denopterin, methotrexate, pteropterin, trimetrexate; purine analogs such as fludarabine, 6-mercaptopurine, thiamiprine, thioguanine; pyrimidine analogs such as ancitabine, azacitidine, 6-azauridine, carmofur, cytarabine, dideoxyuridine, doxifluridine, enocitabine, floxuridine, 5-FU; androgens such as calusterone, dromostanolone propionate, epitiostanol, mepitiostane, testolactone; anti-adrenals such as aminoglutethimide, mitotane, trilostane; folic acid replenisher such as frolinic acid; aceglatone; aldophosphamide glycoside; aminolevulinic acid; amsacrine; bestrabucil; bisantrene; edatraxate; defofamine; demecolcine; diaziquone; elformithine; elliptinium acetate; etoglucid; gallium nitrate; hydroxyurea; lentinan; lonidamine; mitoguazone; mitoxantrone; mopidamol; nitracrine; pentostatin; phenamet; pirarubicin; podophyllinic acid; 2-ethylhydrazide; procarbazine; PSK®; razoxane; sizofiran; spirogermanium; tenuazonic acid; triaziquone; 2, 2',2"-trichlorotriethylamine; urethan; vindesine; dacarbazine; mannomustine; mitobronitol; mitolactol; pipobroman; gacytosine; arabinoside ("Ara-C"); cyclophosphamide; thiotepa; taxoids, e.g., paclitaxel (TAXOL™, Bristol-Myers Squibb) and doxetaxel (TAXOTERE®, Rhone-Poulenc Rorer); chlorambucil; gemcitabine; 6-thioguanine; mercaptopurine; methotrexate; platinum analogs such as cisplatin and carboplatin; vinblastine; platinum; etoposide (VP-16); ifosfamide; mitomycin C; mitoxantrone; vincristine; vinorelbine; navelbine; novantrone; teniposide; daunomycin; aminopterin; xeloda; ibandronate; CPT-11; topoisomerase inhibitor RF 52000; difluoromethylomithine (DMFO); retinoic acid derivatives such as Targretin™ (bexarotene), Panretin™, (alitretinoin); ONTAK™ (denileukin diftitox); esperamicins; capecitabine; and pharmaceutically acceptable salts, acids or derivatives of any of the above. Also included in this definition are anti-hormonal agents that act to regulate or inhibit hormone action on tumors such as anti-estrogens including for example tamoxifen, raloxifene, aromatase inhibiting 4(5)-imidazoles, 4-hydroxytamoxifen, trioxifene, keoxifene, LY117018, onapristone, and toremifene (Fareston); and anti-androgens such as flutamide, nilutamide, bicalutamide, leuprolide, and goserelin; and pharmaceutically acceptable salts, acids or derivatives of any of the above. Combinations of chemotherapeutic agents are also administered where appropriate, including, but not limited to CHOP, i.e., Cyclophosphamide (Cytoxan®), Doxorubicin (hydroxydoxorubicin), Vincristine (Oncovin®), and Prednisone.

In some embodiments, the chemotherapeutic agent is administered at the same time or within one week after the administration of the engineered cell, polypeptide, or nucleic acid. In other embodiments, the chemotherapeutic agent is administered from about 1-7 days, about 1 to about 4 weeks or from about 1 week to about 1 month, about 1 week to about 2 months, about 1 week to about 3 months, about 1 week to about 6 months, about 1 week to about 9 months, or about 1 week to about 12 months after the administration of the engineered cell, polypeptide, or nucleic acid. In other embodiments, the chemotherapeutic agent is administered at least 1 month before administering the cell, polypeptide, or nucleic acid. In some embodiments, the methods further comprise administering two or more chemotherapeutic agents.

A variety of additional therapeutic agents may be used in conjunction with the compositions described herein. For example, potentially useful additional therapeutic agents include PD-1 inhibitors such as nivolumab (Opdivo®), pembrolizumab (Keytruda®), pembrolizumab, pidilizumab, and atezolizumab.

Additional therapeutic agents suitable for use in combination with the disclosure include, but are not limited to, ibrutinib (Imbruvica®), ofatumumab (Arzerra®), rituximab (Rituxan®), bevacizumab (Avastin®), trastuzumab (Herceptin®), trastuzumab emtansine (KADCYLA®, imatinib (Gleevec®), cetuximab (Erbitux®, panitumumab) (Vectibix®), catumaxomab, ibritumomab, ofatumumab, tositumomab, brentuximab, alemtuzumab, gemtuzumab, erlotinib, gefitinib, vandetanib, afatinib, lapatinib, neratinib, axitinib, masitinib, pazopanib, sunitinib, sorafenib, toceranib, lestaurtinib, axitinib, cediranib, lenvatinib, nintedanib, pazopanib, regorafenib, semaxanib, sorafenib, sunitinib, tivozanib, toceranib, vandetanib, entrectinib, cabozantinib, imatinib, dasatinib, nilotinib, ponatinib, radotinib, bosutinib, lestaurtinib, ruxolitinib, pacritinib, cobimetinib, selumetinib, trametinib, binimetinib, alectinib, ceritinib, crizotinib, aflibercept,adipotide, denileukin diftitox, mTOR inhibitors such as Everolimus and Temsirolimus, hedgehog inhibitors such as sonidegib and vismodegib, CDK inhibitors such as CDK inhibitor (palbociclib).

In some embodiments, the composition comprising CAR-containing immune cells may be administered with a therapeutic regimen to prevent or reduce cytokine release syndrome (CRS) or neurotoxicity. The therapeutic regimen to prevent cytokine release syndrome (CRS) or neurotoxicity may include lenzilumab, tocilizumab, atrial natriuretic peptide (ANP), anakinra, iNOS inhibitors (e.g., L-NIL or 1400 W). In additional embodiments, the composition comprising CAR-containing immune cells can be administered with an anti-inflammatory agent. Anti-inflammatory agents or drugs include, but are not limited to, steroids and glucocorticoids (including betamethasone, budesonide, dexamethasone, hydrocortisone acetate, hydrocortisone, hydrocortisone, methylprednisolone, prednisolone, prednisone, triamcinolone), nonsteroidal anti-inflammatory drugs (NSAIDS) including aspirin, ibuprofen, naproxen, methotrexate, sulfasalazine, leflunomide, anti-TNF medications, cyclophosphamide and mycophenolate. Exemplary NSAIDs include ibuprofen, naproxen, naproxen sodium, Cox-2 inhibitors, and sialylates. Exemplary analgesics include acetaminophen, oxycodone, tramadol of proporxyphene hydrochloride. Exemplary glucocorticoids include cortisone, dexamethasone, hydrocortisone, methylprednisolone, prednisolone, or prednisone. Exemplary biological response modifiers include molecules directed against cell surface markers (e.g., CD4, CD5, etc.), cytokine inhibitors, such as the TNF antagonists, (e.g., etanercept (ENBREL®), adalimumab (HUMIRA®) and infliximab (REMICADE®)), chemokine inhibitors and adhesion molecule inhibitors. The biological response modifiers include monoclonal antibodies as well as recombinant forms of molecules. Exemplary DMARDs include azathioprine, cyclophosphamide, cyclosporine, methotrexate, penicillamine, leflunomide, sulfasalazine, hydroxychloroquine, Gold (oral (auranofin) and intramuscular) and minocycline.

In certain embodiments, the compositions described herein are administered in conjunction with a cytokine. Examples of cytokines are lymphokines, monokines, and traditional polypeptide hormones. Included among the cytokines are growth hormones such as human growth hormone, N-methionyl human growth hormone, and bovine growth hormone; parathyroid hormone; thyroxine; insulin; proinsulin; relaxin; prorelaxin; glycoprotein hormones such as follicle stimulating hormone (FSH), thyroid stimulating hormone (TSH), and luteinizing hormone (LH); hepatic growth factor (HGF); fibroblast growth factor (FGF); prolactin; placental lactogen; mullerian-inhibiting substance; mouse gonadotropin-associated peptide; inhibin; activin; vascular endothelial growth factor; integrin; thrombopoietin (TPO); nerve growth factors (NGFs) such as NGF-beta; platelet-growth factor; transforming growth factors (TGFs) such as TGF-alpha and TGF-beta; insulin-like growth factor-I and -II; erythropoietin (EPO); osteoinductive factors; interferons such as interferon-alpha, beta, and -gamma; colony stimulating factors (CSFs) such as macrophage-CSF (M-CSF); granulocyte-macrophage-CSF (GM-CSF); and granulocyte-CSF (G-CSF); interleukins (ILs) such as IL-1, IL-1alpha, IL-2, IL-3, IL-4, IL-5, IL-6, IL-7, IL-8, IL-9, IL-10, IL-11, IL-12; IL-15, IL-21 a tumor necrosis factor such as TNF-alpha or TNF-beta; and other polypeptide factors including LIF and kit ligand (KL). As used herein, the term cytokine includes proteins from natural sources or from recombinant cell culture, and biologically active equivalents of the native sequence cytokines.

V. Methods of Sorting and Depletion

In some embodiments, provided are methods for in vitro sorting of a population of immune cells, wherein a subset of the population of immune cells comprises engineered immune cells expressing any one of the DLL3-specific CARs comprising epitopes specific for monoclonal antibodies (e.g., exemplary mimotope sequences). The method comprises contacting the population of immune cells with a monoclonal antibody specific for the epitopes and selecting the immune cells that bind to the monoclonal antibody to obtain a population of cells enriched in engineered immune cells expressing the DLL3-specific CAR.

In some embodiments, said monoclonal antibody specific for said epitope is optionally conjugated to a fluorophore. In this embodiment, the step of selecting the cells that bind to the monoclonal antibody can be done by Fluorescence Activated Cell Sorting (FACS).

In some embodiments, said monoclonal antibody specific for said epitope is optionally conjugated to a magnetic particle. In this embodiment, the step of selecting the cells that bind to the monoclonal antibody can be done by Magnetic Activated Cell Sorting (MACS).

In some embodiments, the mAb used in the method for sorting immune cells expressing the CAR is chosen from alemtuzumab, ibritumomab tiuxetan, muromonab-CD3, tositumomab, abciximab, basiliximab, brentuximab vedotin, cetuximab, infliximab, rituximab, bevacizumab, certolizumab pegol, daclizumab, eculizumab, efalizumab, gemtuzumab, natalizumab, omalizumab, palivizumab, ranibizumab, tocilizumab, trastuzumab, vedolizumab, adalimumab, belimumab, canakinumab, denosumab, golimumab, ipilimumab, ofatumumab, panitumumab, QBEND-10 and/or ustekinumab. In some embodiments, said mAb is rituximab. In another embodiment, said mAb is QBEND-10.

In some embodiments, the population CAR-expressing immune cells obtained when using the method for in vitro sorting CAR-expressing immune cells described above, comprises at least 70%, 75%, 80%, 85%, 90%, 95% of CAR-expressing immune cells. In some embodiments, the population of CAR-expressing immune cells obtained when using the method for in vitro sorting CAR-expressing immune cells, comprises at least 85% CAR-expressing immune cells.

In some embodiments, the population of CAR-expressing immune cells obtained when using the method for in vitro sorting CAR-expressing immune cells described above shows increased cytotoxic activity in vitro compared with the initial (non-sorted) cell population. In some embodiments, said cytotoxic activity in vitro is increased by 10%, 20%, 30% or 50%. In some embodiments, the immune cells are T-cells.

In some embodiments, the mAbs are previously bound onto a support or surface. Non-limiting examples of solid support may include a bead, agarose bead, a plastic bead a magnetic bead, a plastic welled plate, a glass welled plate, a ceramic welled plate, a column, or a cell culture bag.

The CAR-expressing immune cells to be administered to the recipient may be enriched in vitro from the source population. Methods of expanding source populations may include selecting cells that express an antigen such as CD34 antigen, using combinations of density centrifugation, immuno-magnetic bead purification, affinity chromatography, and fluorescent activated cell sorting.

Flow cytometry is may be used to quantify specific cell types within a population of cells. In general, flow cytometry is a method for quantitating components or structural features of cells primarily by optical means. Since different cell types can be distinguished by quantitating structural features, flow cytometry and cell sorting can be used to count and sort cells of different phenotypes in a mixture.

A flow cytometry analysis involves two primary steps: 1) labeling selected cell types with one or more labeled markers, and T) determining the number of labeled cells relative to the total number of cells in the population. In some embodiments, the method of labeling cell types includes binding labeled antibodies to markers expressed by the specific cell type. The antibodies may be either directly labeled with a fluorescent compound or indirectly labeled using, for example, a fluorescent-labeled second antibody which recognizes the first antibody.

In a some embodiments, the method used for sorting T cells expressing CAR is the Magnetic-Activated Cell Sorting (MACS). Magnetic-activated cell sorting (MACS) is a method for separation of various cell populations depending on their surface antigens (CD molecules) by using superparamagnetic nanoparticles and columns. MACS may be used to obtain a pure cell population. Cells in a single-cell suspension may be magnetically labeled with microbeads. The sample is applied to a column composed of ferromagnetic spheres, which are covered with a cell-friendly coating allowing fast and gentle separation of cells. The unlabeled cells pass through while the magnetically labeled cells are retained within the column. The flow-through can be collected as the unlabeled cell fraction. After a washing step, the column is removed from the separator, and the magnetically labeled cells are eluted from the column.

Detailed protocol for the purification of specific cell population such as T-cell can be found in Basu S et al. (2010). (Basu S, Campbell H M, Dittel B N, Ray A. Purification of specific cell population by fluorescence activated cell sorting (FACS). J Vis Exp. (41): 1546).

In some aspects the present disclosure provides a method for depleting DLL3 specific CAR-expressing immune cells by in vivo depletion. in vivo depletion may include the administration of a treatment (e.g., a molecule that binds an epitope on the CAR) to a mammalian organism aiming to stop the proliferation of the CAR-expressing immune cells by inhibition or elimination.

One aspect of the invention is related to a method for in vivo depleting an engineered immune cell expressing a DLL3 CAR comprising a mAb specific epitope, comprising contacting said engineered immune cell or said CAR-expressing immune cell with at least one epitope-specific mAb. Another aspect of the invention relates to a method for in vivo depleting CAR-expressing immune cell which comprises a chimeric scFv (e.g., formed by insertion of a mAb-specific epitope) by contacting said engineered immune cell with epitope-specific antibodies. In some embodiments, the immune cells are T-cells and/or the antibodies are monoclonal.

According to one embodiment, the in vivo depletion of the immune engineered cells is performed on engineered immune cells which has been previously sorted using the in vitro method of the present invention. In this case, the same infused mAb may be used. In some embodiments, the mAb-specific antigen is CD20 antigen and the epitope-specific mAb is rituximab. In some embodiments, the invention relates to a method for in vivo depleting an engineered immune cell expressing a CAR comprising an mAb-specific epitope (CAR-expressing immune cell) in a patient comprising contacting said CAR-expressing immune cell with at least one epitope-specific mAb.

In some embodiments, the step of contacting said engineered immune cell or said CAR-expressing immune cell with at least one epitope-specific mAb comprises infusing the patient with epitope-specific mAb (e.g., rituximab). In some embodiments, the amount of epitope-specific mAb administered to the patient is sufficient to eliminate at least 20%, 30%, 40%, 50%, 60%, 70%, 80% or 90% of the CAR-expressing immune cell in the patient.

In some embodiments, the step of contacting said engineered immune cell or said CAR-expressing immune cell with at least one epitope-specific mAb comprises infusing the patient with about 375 mg/m$^2$ of rituximab, once or several times. In some embodiments, the mAb (e.g., rituximab) is administered once weekly.

In some embodiments, when immune cells expressing a CAR comprising an mAb-specific epitope (CAR-expressing immune cells) are depleted in a complement dependent cytotoxicity (CDC) assay using epitope-specific mAb, the amount of viable CAR-expressing immune cells decreases. In some embodiments, the amount of viable CAR-expressing immune cells decreases by at least 10%, 20%, 30%, 40%, 50%, 60%, 70%, 80% or 90%. In some embodiments, said mAb-specific epitope is a CD20 epitope or mimotope and/or the epitope-specific mAb is rituximab.

In certain embodiments, the in vivo depletion of CAR-engineered immune cells is performed by infusing bi-specific antibodies. By definition, a bispecific monoclonal antibody (BsAb) is an artificial protein that is composed of fragments of two different monoclonal antibodies and consequently binds to two different types of antigen. These BsAbs and their use in immunotherapy have been reviewed in Muller D and Kontermann R. E. (2010) Bispecific Antibodies for Cancer Immunotherapy, BioDrugs 24 (2): 89-98.

According to another particular embodiment, the infused bi-specific mAb is able to bind both the mAb-specific epitope borne on engineered immune cells expressing the chimeric scFv and to a surface antigen on an effector and cytotoxic cell (e.g., immune cells such as lymphocytes, macrophages, dendritic cells, natural killer cells (NK Cell), cytotoxic T lymphocytes (CTL)). By doing so, the depletion of engineered immune cells triggered by the BsAb may occur through antibody-dependent cellular cytotoxicity (ADCC). (Deo Y M, Sundarapandiyan K, Keler T, Wallace P K, and Graziano R F, (2000), Journal of Immunology, 165 (10):5954-5961]).

In some embodiments, a cytotoxic drug is coupled to the epitope-specific mAbs which may be used to deplete CAR-expressing immune cells. By combining targeting capabilities of monoclonal antibodies with the cancer-killing ability of cytotoxic drugs, antibody-drug conjugate (ADC) allows a sensitive discrimination between healthy and diseased tissue when compared to the use of the drug alone. Market approvals were received for several ADCs; the technology for making them—particularly on linkers—are described in (Payne, G. (2003) Cancer Cell 3:207-212; Trail et al (2003) Cancer Immunol. Immunother. 52:328-337; Syrigos and Epenetos (1999) Anticancer Research 19:605-614; Niculescu-Duvaz and Springer (1997) Adv. Drug Del. Rev. 26:151-172; U.S. Pat. No. 4,975,278).

In some embodiments, the epitope-specific mAb to be infused is conjugated beforehand with a molecule able to promote complement dependent cytotoxicity (CDC). Therefore, the complement system helps or complements the ability of antibodies to clear pathogens from the organism. When stimulated an activation cascade is triggered as a massive amplification of the response and activation of the cell-killing membrane attack complex. Different molecule may be used to conjugate the mAb, such as glycans (Courtois, A, Gac-Breton, S., Berthou, C, Guezennec, J., Bordron, A. and Boisset, C. (2012), Complement dependent cytotoxicity activity of therapeutic antibody fragments may be acquired by immunogenic glycan coupling, Electronic Journal of Biotechnology ISSN: 0717-3458; http://www.ejbiotechnology.info DOI: 10.2225/vol15-issue5).

VI. Kits and Articles of Manufacture

The present application provides kits comprising any one of the DLL3 containing CARs or DLL3 CAR containing immune cells described herein, and pharmaceutical compositions of the same. In an embodiment of a kit the engineered CAR cells are frozen in a suitable medium, such as CryoStor® CS10, CryoStor® CS2 or CryoStor® CS5 (BioLife Solutions).

In some exemplary embodiments, a kit of the disclosure comprises allogeneic DLL3 CAR-containing T-cells and a CD52 antibody for administering to the subject a lymphodepletion regiment and a CAR-T regimen.

The present application also provides articles of manufacture comprising any one of the therapeutic compositions or kits described herein. Examples of an article of manufacture include vials (e.g., sealed vials).

EXAMPLES

Example 1: Generation and Testing of DLL3 Targeting Antibodies

The monoclonal antibodies to be used in accordance with the invention may be made by the hybridoma method first described by Kohler and Milstein, Nature 256:495, 1975, or may be made by recombinant DNA methods such as described in U.S. Pat. No. 4,816,567. Anti-DLL3 antibodies were first screened in Flag-DLL3 (adipogen) ELISA and then screened in FACS to determine binding to HEK-293T cells with or without human DLL3 expression.

To test if the DLL3 specific antibodies can recognize cells that express endogenous DLL3, DMS 273 (Sigma, cat #95062830), DMS 454 (Sigma, cat #95062832), and SHP-77 (ATCC, cat # CRL-2195) cells were stained with 2 ug/ml of purified DLL3 antibodies with mouse IgG2A backbone (mIgG2a) or control mIgG2a antibody in PBS supplemented with 1% BSA. Bound DLL3 antibodies were detected with PE labelled anti-mouse IgG antibody (Biolegend, cat #405307). The samples were analyzed by flow cytometry. Representative images showing binding of DLL3 antibodies to DMS 273, DMS 454 and SHP-77 cells are included in FIG. 1.

Example 2: Determination of Kinetics and Affinity of Anti-DLL3 Antibodies Toward DLL3

This example determines the binding kinetics and affinity of various anti-DLL3 antibodies at 37° C. as both full-length monoclonal antibodies (IgG) and scFvs toward human, cynomolgus monkey (cyno) and mouse DLL3. For the scFvs, the variable regions of the anti-DLL3 antibodies derived from their respective hybridoma were cloned flanking a (GGGGS)$_3$ (SEQ ID NO: 472) or (GGGGS)$_4$ (SEQ ID NO: 478) linker followed by part of the hinge and Fc from a modified human IgG2 sequence resulting in a scFv-Fc fusion which was expressed using Expi293. The extracellular domain (ECD) from human, cyno and mouse DLL3 was fused with a C-terminal 8×His epitope tag (SEQ ID NO: 473) and Avi tag, expressed using Expi293 then purified by immobilized metal affinity chromatography (IMAC) followed by size exclusion chromatography (SEC).

The antibody binding kinetics were determined by surface plasmon resonance (Biacore™ surface plasmon resonance (SPR) system, GE Healthcare Bio-Sciences, Pittsburgh Pa.). The antibodies diluted in HBS-T+ running buffer (0.01 M HEPES pH 7.4, 0.15 M NaCl, 0.05% v/v Tween20, 1 mg/mL BSA) were captured on a CM4 chip immobilized with an antibody specific for the anti-DLL3 antibody constant domains. Purified DLL3 was serially diluted into HBS-T+, injected for 2 min at 30 uL/min and a dissociation time of 10 min then the surface regenerated with either 10 mM Glycine-HCl pH 1.7 or phosphoric acid between injections. Kinetic association rates (kon) and dissociation rates (koff) are obtained simultaneously by fitting the data globally to a 1:1 Langmuir binding model (Karlsson, R. Roos, H. Fagerstam, L. Petersson, B. (1994). Methods Enzymology 6. 99-110) using the BIAevaluation program. Equilibrium dissociation constant ($K_d$) values are calculated as $k_{off}/k_{on}$.

The kinetics and affinity parameters for tested anti-DLL3 antibodies are shown in Table 8. Specifically, Table 8 shows the affinity of anti-DLL3 antibodies (either as IgG or scFv-Fc fusion) to human, cyno and mouse DLL3. The last column shows which extracellular domain of human DLL3 each of anti-DLL3 antibodies recognizes

TABLE 8

Affinity of anti-DLL3 antibodies

| Clones | IgG affinity to huDLL3 (nM) | ScFv affinity to huDLL3 (nM) | ScFv affinity to cynoDLL3 (nM) | ScFv affinity to msDLL3 (nM) | Binding domain |
|---|---|---|---|---|---|
| 2D3 | 5.47 | ND | ND | ND | EGF3 |
| 5E12 | 7.76 | ND | ND | ND | DSL |
| 26C8 | 5.54 | 5.53 | 4.51 | 3.05 | EGF3 |
| 2A6.C5 | 23.4 | 48.4 | 46.8 | 42.1 | EGF3 |
| 6D8 | <1.42 | <1.2 | NB | <1.5 | EGF1 |
| 7F9 | 12.67 | 27.3 | >250 | NB | N-ter |
| 8E11 | 5.86 | 11.2 | 10.5 | 7.03 | EGF3 |
| 9D3 | 21.1 | 23.3 | 21.8 | 7.19 | EGF3 |
| 2G1 | 38.1 | 17.2 | 20.5 | 2.61 | EGF5 |
| 3F2 | 14.8 | 8.18 | 6.81 | N | N-ter |
| 17A2 | 5.49 | 3.82 | <0.97 | N | EGF1 |
| 6F8 | 26.5 | 40.8 | NB | 19.3 | EGF5 |
| 9H12-K | ND | 186 | NB | NB | EGF4 |
| 4H8 | 18.5 | 23.3 | 27.0 | 18.6 | EGF4 |
| 10G1-K | ND | 26.3 | 28.8 | 27.7 | EGF5 |
| 11 A3 | 4.8 | ND | ND | ND | EGF3 |

N-ter = N-terminus
ND = Not Determined
NB = No Binding

Example 3: Generation of CHO Cells Expressing Full Length and Truncated DLL3

A panel of CHO cells expressing full length and a variety of truncated human DLL3 were used to determine which domain each DLL3 targeting antibody recognizes. The extracellular domain of human DLL3 can be subdivided into different sub-domains that are defined by the following amino acid positions: Signal peptide: 1-26; N-terminus (N-ter): 27-175; DSL: 176-215; EGF1:215-249; EGF2:274-310; EGF3:312-351; EGF4:353-389; EGF5: 391-427; and EGF6: 429-465.

To generate truncated DLL3 proteins used for epitope mapping, the sequences of the respective 8 extracellular domains (signal peptide plus N-terminus, DSL, EGF1, EGF2, EGF3, EGF4, EGF5 and EGF6) of human DLL3 were deleted one by one from the antigen, starting from the N-terminus. Table 6 shows the truncated DLL3 proteins that were generated (also see FIGS. 2A-2D).

TABLE 6

Truncated DLL3 proteins

| Name/Component | Sequence |
|---|---|
| Human DLL3 complete ECD (SEQ ID NO: 556) | METDTLLLWVLLLWVPGSTGYPYDVPDYAGMLAG VFELQIHSFGPGPGPGAPRSPCSARLPCRLFFRV CLKPGLSEEAAESPCALGAALSARGPVYTEQPGA PAPDLPLPDGLLQVPFRDAWPGTFSFIIETWREE LGDQIGGPAWSLLARVAGRRRLAAGGPWARDIQR AGAWELRFSYRARCEPPAVGTACTRLCRPRSAPS RCGPGLRPCAPLEDECEAPLVCRAGCSPEHGFCE QPGECRCLEGWTGPLCTVPVSTSSCLSPRGPSSA TTGCLVPGPGPCDGNPCANGGSCSETPRSFECTC PRGFYGLRCEVSGVTCADGPCFNGGLCVGGADPD SAYICHCPPGFQGSNCEKRVDRCSLQPCRNGGLC LDLGHALRCRCRAGFAGPRCEHDLDDCAGRACAN GGTCVEGGGAHRCSCALGFGGRDCRERADPCAAR PCAHGGRCYAHFSGLVCACAPGYMGARCEFPVHP |

TABLE 6-continued

Truncated DLL3 proteins

| Name/Component | Sequence |
|---|---|
| | DGASALPAAPPGLRPGDPQRYLLPPALGLLVAAG VAGAALLLVHVRRRGHSQDAGSRLLAGTPEPSVH ALPDALNNLRTQEGSGDGPSSSVDWNRPEDVDPQ GIYVISAPSIYAREVATPLFPPLHTGRAGQRQHL LFPYPSSILSVK |
| Human DLL3 DSL-EGF6 (SEQ ID NO: 557) | METDTLLLWVLLLWVPGSTGYPYDVPDYAGMLGSA RCEPPAVGTACTRLCRPRSAPSRCGPGLRPCAPLE DECEAPLVCRAGCSPEHGFCEQPGECRCLEGWTGP LCTVPVSTSSCLSPRGPSSATTGCLVPGPGPCDGN PCANGGSCSETPRSFECTCPRGFYGLRCEVSGVTC ADGPCFNGGLCVGGADPDSAYICHCPPGFQGSNCE KRVDRCSLQPCRNGGLCLDLGHALRCRCRAGFAGP RCEHDLDDCAGRACANGGTCVEGGGAHRCSCALGF GGRDCRERADPCAARPCAHGGRCYAHFSGLVCACA PGYMGARCEFPVHPDGASALPAAPPGLRPGDPQRY LLPPALGLLVAAGVAGAALLLVHVRRRGHSQDAGS RLLAGTPEPSVHALPDALNNLRTQEGSGDGPSSSV DWNRPEDVDPQGIYVISAPSIYAREVATPLFPPLH TGRAGQRQHLLFPYPSSILSVK |
| Human DLL3 EGF1- EGF6 (SEQ ID NO: 558) | METDTLLLWVLLLWVPGSTGYPYDVPDYAGMLGSA PLVCRAGCSPEHGFCEQPGECRCLEGWTGPLCTVP VSTSSCLSPRGPSSATTGCLVPGPGPCDGNPCANG GSCSETPRSFECTCPRGFYGLRCEVSGVTCADGPC FNGGLCVGGADPDSAYICHCPPGFQGSNCEKRVDR CSLQPCRNGGLCLDLGHALRCRCRAGFAGPRCEHD LDDCAGRACANGGTCVEGGGAHRCSCALGFGGRDC RERADPCAARPCAHGGRCYAHFSGLVCACAPGYMG ARCEFPVHPDGASALPAAPPGLRPGDPQRYLLPPA LGLLVAAGVAGAALLLVHVRRRGHSQDAGSRLLAG TPEPSVHALPDALNNLRTQEGSGDGPSSSVDWNRP EDVDPQGIYVISAPSIYAREVATPLFPPLHTGRAG QRQHLLFPYPSSILSVK |
| Human DLL3 EGF2- EGF6 (SEQ ID NO: 559) | METDTLLLWVLLLWVPGSTGYPYDVPDYAGMLGSG PGPCDGNPCANGGSCSETPRSFECTCPRGFYGLRC EVSGVTCADGPCFNGGLCVGGADPDSAYICHCPPG FQGSNCEKRVDRCSLQPCRNGGLCLDLGHALRCRC RAGFAGPRCEHDLDDCAGRACANGGTCVEGGGAHR CSCALGFGGRDCRERADPCAARPCAHGGRCYAHFS GLVCACAPGYMGARCEFPVHPDGASALPAAPPGLR PGDPQRYLLPPALGLLVAAGVAGAALLLVHVRRRG HSQDAGSRLLAGTPEPSVHALPDALNNLRTQEGSG DGPSSSVDWNRPEDVDPQGIYVISAPSIYAREVAT PLFPPLHTGRAGQRQHLLFPYPSSILSVK |
| Human DLL3 EGF3- EGF6 (SEQ ID NO: 560) | METDTLLLWVLLLWVPGSTGYPYDVPDYAGMLGSS GVTCADGPCFNGGLCVGGADPDSAYICHCPPGFQG SNCEKRVDRCSLQPCRNGGLCLDLGHALRCRCRAG FAGPRCEHDLDDCAGRACANGGTCVEGGGAHRCSC ALGFGGRDCRERADPCAARPCAHGGRCYAHFSGLV CACAPGYMGARCEFPVHPDGASALPAAPPGLRPGD PQRYLLPPALGLLVAAGVAGAALLLVHVRRRGHSQ DAGSRLLAGTPEPSVHALPDALNNLRTQEGSGDGP SSSVDWNRPEDVDPQGIYVISAPSIYAREVATPLF PPLHTGRAGQRQHLLFPYPSSILSVK |
| Human DLL3 EGF4- EGF6 (SEQ ID NO: 561) | METDTLLLWVLLLWVPGSTGYPYDVPDYAGMLGSR VDRCSLQPCRNGGLCLDLGHALRCRCRAGFAGPRC EHDLDDCAGRACANGGTCVEGGGAHRCSCALGFGG RDCRERADPCAARPCAHGGRCYAHFSGLVCACAPG YMGARCEFPVHPDGASALPAAPPGLRPGDPQRYLL PPALGLLVAAGVAGAALLLVHVRRRGHSQDAGSRL LAGTPEPSVHALPDALNNLRTQEGSGDGPSSSVDW NRPEDVDPQGIYVISAPSIYAREVATPLFPPLHTG RAGQRQHLLFPYPSSILSVK |
| Human DLL3 EGF5- EGF6 (SEQ ID NO: 562) | METDTLLLWVLLLWVPGSTGYPYDVPDYAGMLGSD LDDCAGRACANGGTCVEGGGAHRCSCALGFGGRDC RERADPCAARPCAHGGRCYAHFSGLVCACAPGYMG ARCEFPVHPDGASALPAAPPGLRPGDPQRYLLPPA LGLLVAAGVAGAALLLVHVRRRGHSQDAGSRLLAG TPEPSVHALPDALNNLRTQEGSGDGPSSSVDWNRP EDVDPQGIYVISAPSIYAREVATPLFPPLH TGRAGQRQHLLFPYPSSILSVK |
| Human DLL3 EGF6 (SEQ ID NO: 563) | METDTLLLWVLLLWVPGSTGYPYDVPDYAGMLGSR ADPCAARPCAHGGRCYAHFSGLVCACAPGYMGARC EFPVHPDGASALPAAPPGLRPGDPQRYLLPPALGL LVAAGVAGAALLLVHVRRRGHSQDAGSRLLAGTPE PSVHALPDALNNLRTQEGSGDGPSSSVDWNRPEDV DPQGIYVISAPSIYAREVATPLFPPLHTGRAGQRQ HLLFPYPSSILSVK |

To establish CHO cells expressing full length and truncated human DLL3 with an N-terminal HA tag, the coding sequences for full length human DLL3 (SEQ ID NO: 556; GeneBank record NM_016941) and the 7 HA-tagged truncated human DLL3 (SEQ ID NOs: 557 to 563) were cloned into pLVX-SFFV-Puro-P2A-TetO3G vector (Clontech). A lentivirus encoding either the full length or truncated human DLL3s were generated by co-transfecting 293T cells with the pLVX-SFFV-Puro-P2A-TetO3G vectors with psPAX2 and pMD2G vectors. Two days after transfection, supernatant containing viral particles were collected and used to transduce CHO cells together with 5 ug/ml of polybrene.

Figure 2A:
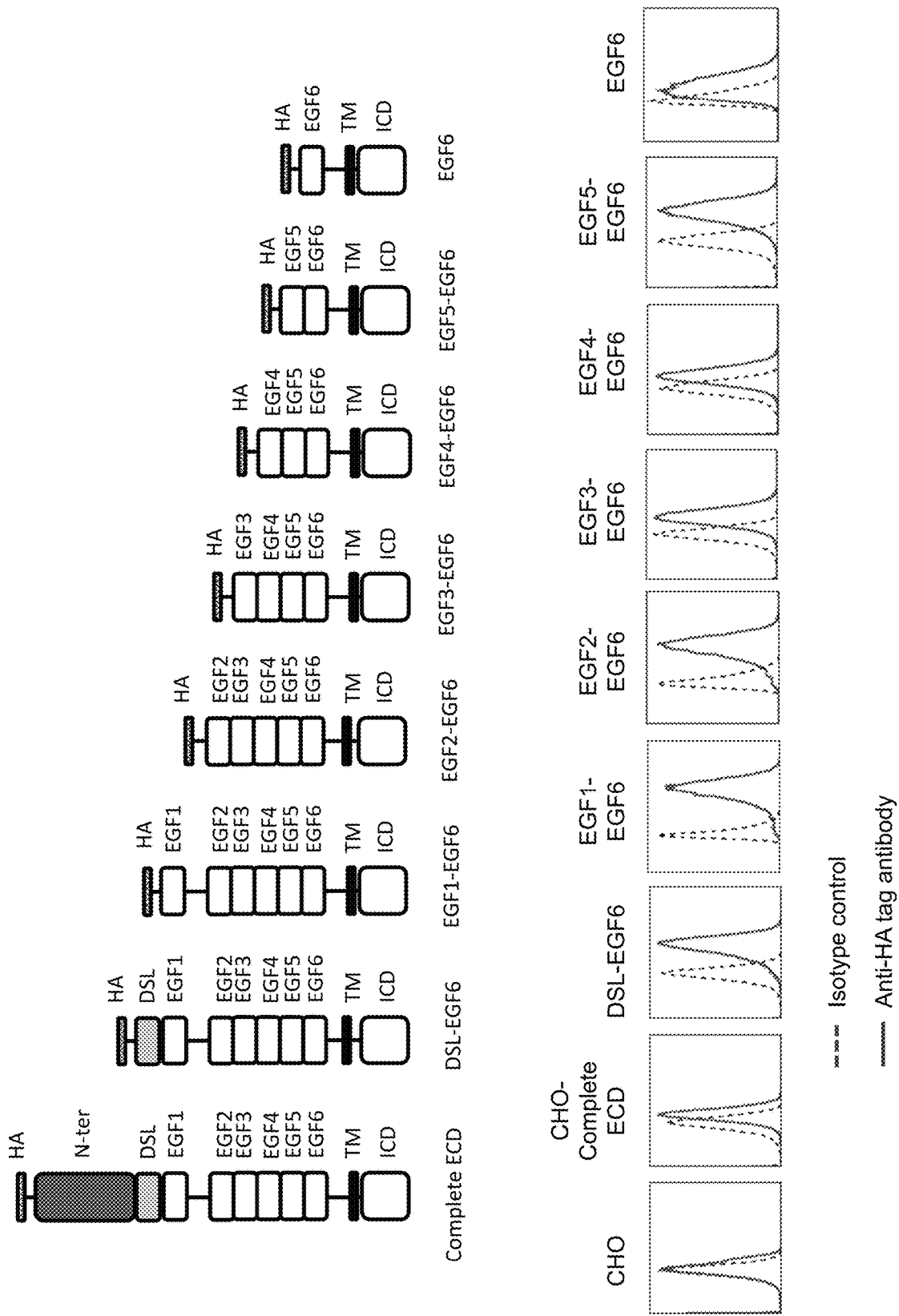
Figure 2D:
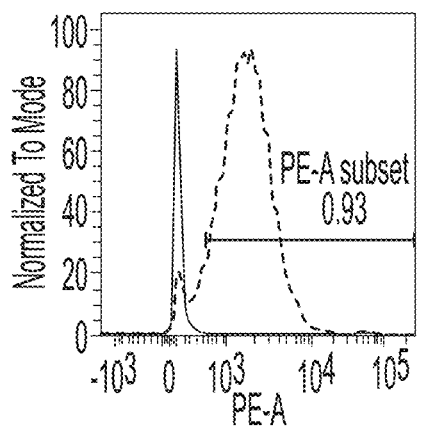
Figure 2D:
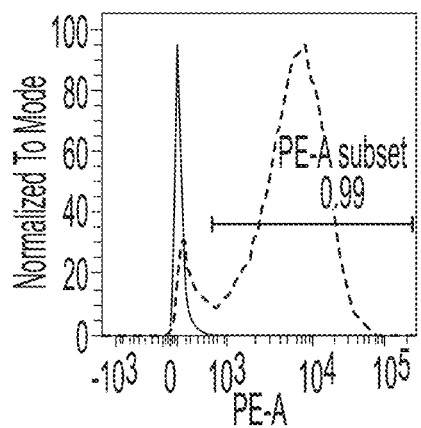
Figure 2D:
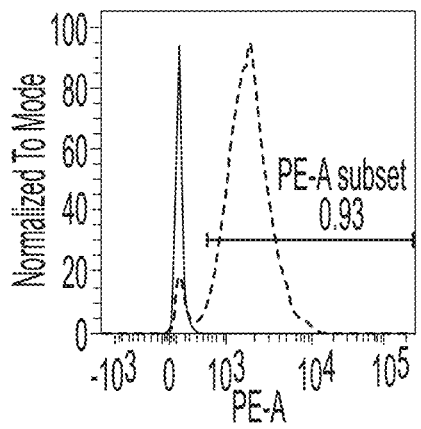
Figure 2D:
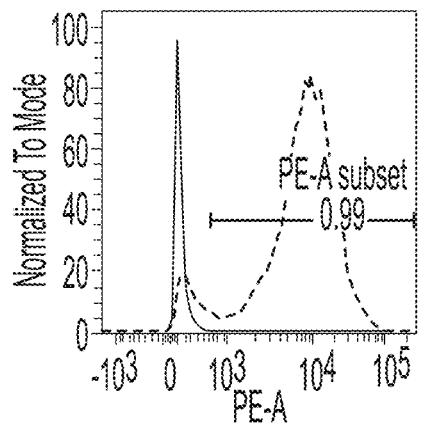
Figure 2D:
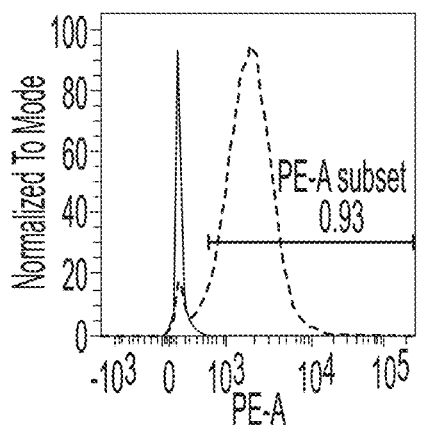
Figure 2D:
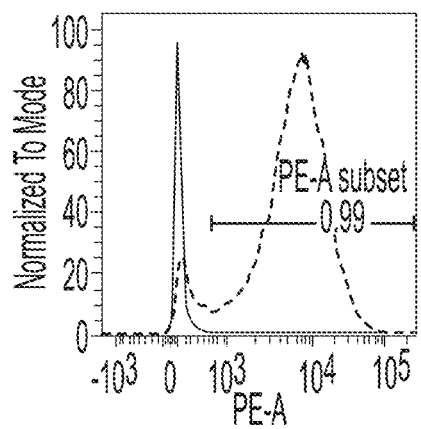
Figure 2D:
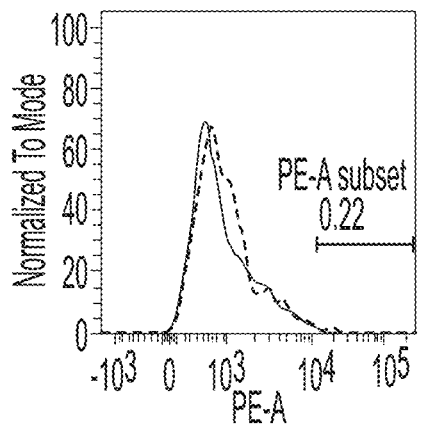
Figure 2D:
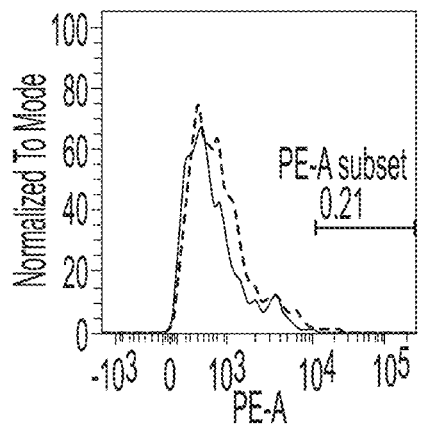
Figure 2D:
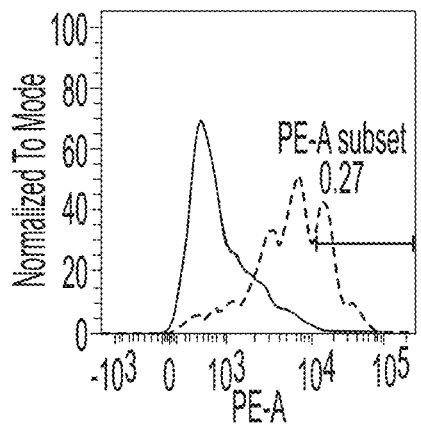
Figure 2D:
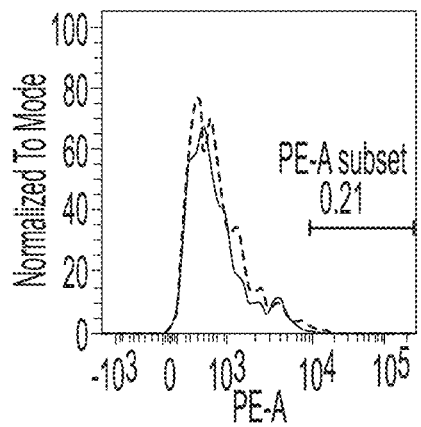
Figure 2D:
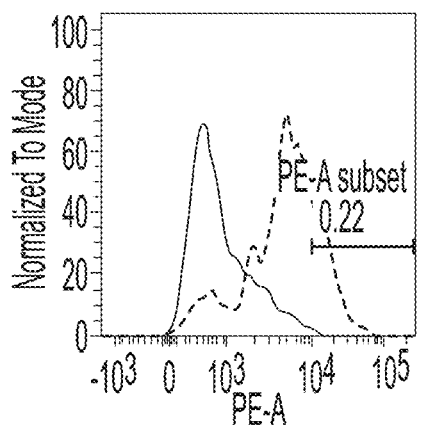
Figure 2D:
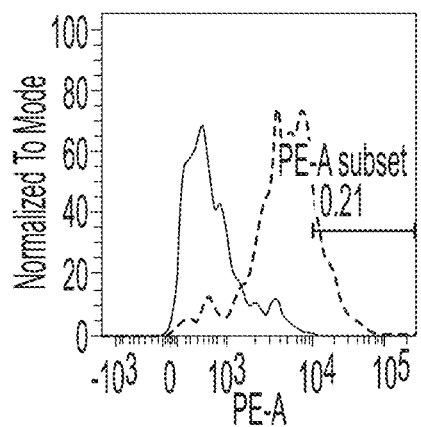
Figure 2D:
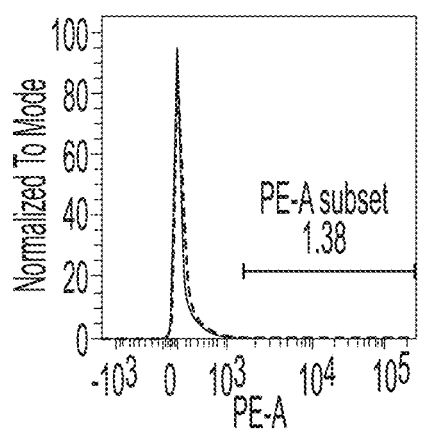
Figure 2D:
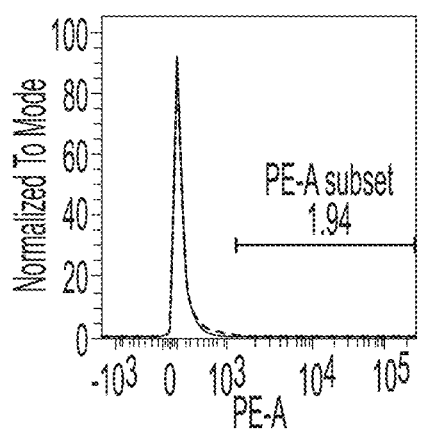
Figure 2D:
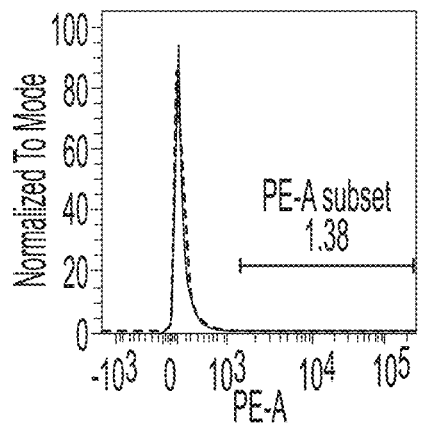
Figure 2D:
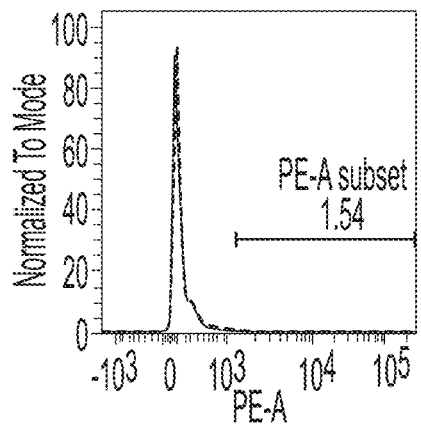
Figure 2D:
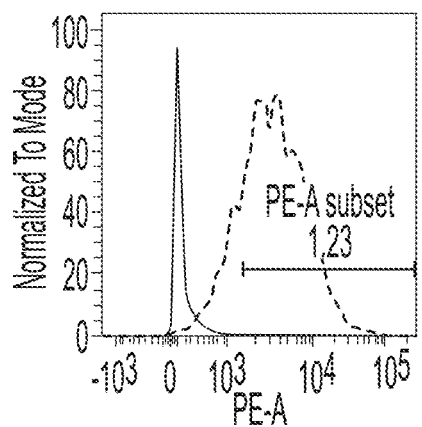
Figure 2D:
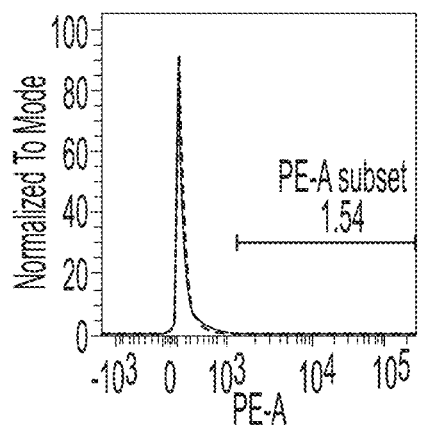
Figure 2D:
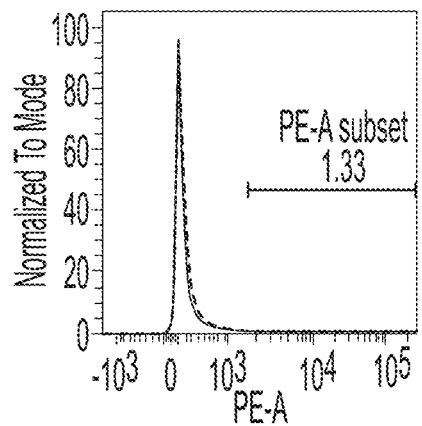
Figure 2D:
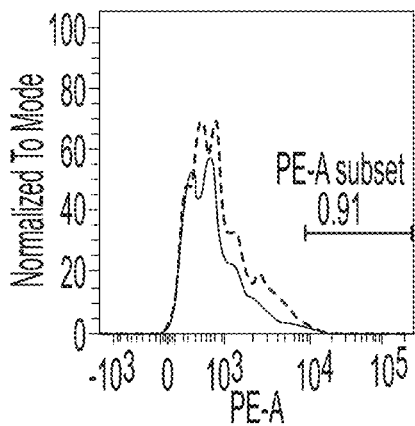
Figure 2D:
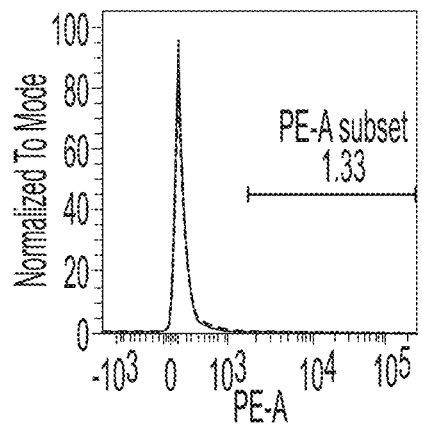
Figure 2D:
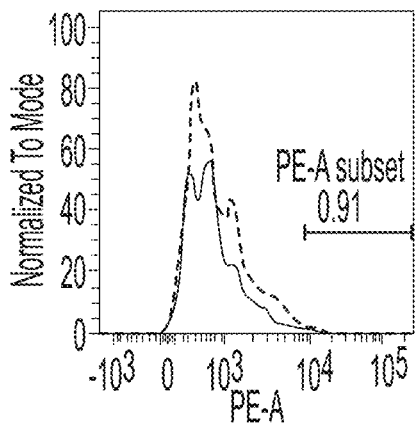
Figure 2D:
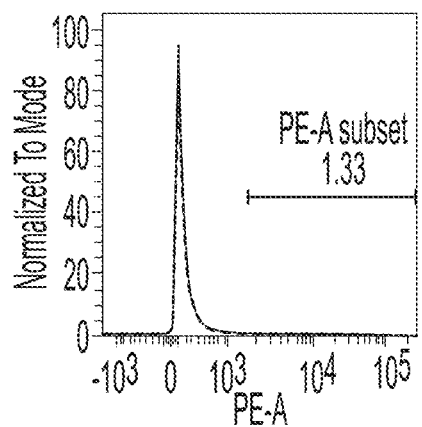
Figure 2D:
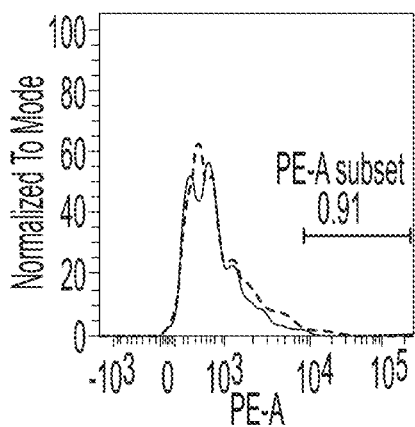

The expression of full length and truncated DLL3 was verified in a FACS assay using PE conjugated anti-HA antibody (Biolegend, cat #901518). As negative control, cells were incubated with isotype-matched and PE-labelled antibody (Biolegend, cat #400111) instead of anti-HA antibody. The bottom panel of FIG. 2A shows the expression of full length and truncated DLL3 on CHO cells.

Example 4: Epitope Mapping of DLL3 Targeting Antibodies

CHO cells expressing full length and truncated DLL3 were stained with hybridoma supernatant or purified DLL3 antibodies in PBS+1% BSA. Bound DLL3 antibodies were detected with PE labelled anti-mouse IgG antibody (Biolegend, cat #405307). The samples were analyzed by flow cytometry. The binding domain for each clone was determined using the panel of CHO expressing full length or truncated DLL3 described in Example 2. Flow cytometry analysis demonstrated that, for example, if a clone binds to all truncated proteins including EGF3 but not to any truncated protein without EGF3, then such clone recognizes EGF3. As shown in the representative images in FIG. 2D, anti-DLL3 antibodies recognize DSL, EGF1 and EGF3 domains, respectively. Signals from the PE channel are shown on the x-axis and counts are shown on the y-axis.

Example 5: Generation of DLL3 Specific CAR-T Cells

This example describes the construction of anti-DLL3 chimeric antigen receptors (CARs).

The anti-DLL3 antibodies listed in Table 1a were reformatted to CARs. The amino acid sequences of the heavy chain variable regions and light chain variable regions of these antibodies (Table 1b and Table 1c) were used to design single chain variable fragments (scFvs) (Table 1d) having the following general structure: heavy chain variable region--linker--light chain variable region. The linker had the following amino acid sequences GGGGSGGGGSGGGGSGGGGS (SEQ ID NO: 478).

Protein sequences encoding chimeric antigen receptor were designed to contain the following elements from 5' to 3' (FIG. 3A, Table 7): the CD8α signal sequence (SEQ ID NO: 477), an anti-DLL3 scFv, hinge and transmembrane regions of the human CD8α molecule (SEQ ID NO: 479), the cytoplasmic portion of the 41BB molecule (SEQ ID NO: 291) and the cytoplasmic portion of the CD3ζ molecule (SEQ ID NO: 292).

TABLE 7

CAR amino acid sequences

| SEQ ID NO: | Name/Component | Sequence |
|---|---|---|
| 477 | CD8α signal sequence | MALPVTALLLPLALLLHAARP |
| 478 | linker | GGGGSGGGGSGGGGSGGGGS |
| 479 | CD8α hinge and transmembrane regions | TTTPAPRPPTPAPTIASQPLSLRPEACRPAAGGAVHTRGLDFAC DIYIWAPLAGTCGVLLLSLVIT |
| 480 | 41BB cytoplasmic signaling domain | KRGRKKLLYIFKQPFMRPVQTTQEEDGCSCRFPEEEEGGCEL |
| 481 | CD3ζ cytoplasmic signaling domain | LRVKFSRSADAPAYQQGQNQLYNELNLGRREEYDVLDKRRG RDPEMGGKPRRKNPQEGLYNELQKDKMAEAYSEIGMKGERR RGKGHDGLYQGLSTATKDTYDALHMQALPPR |
| 469 | CD3ζ cytoplasmic signaling domain | LRVKFSRSADAPAYKQGQNQLYNELNLGRREEYDVLDKRRG RDPEMGGKPRRKNPQEGLYNELQKDKMAEAYSEIGMKGERR RGKGHDGLYQGLSTATKDTYDALHMQALPPR |
| 482 | CD8α signal sequence, 2D3 scFv, CD8α hinge and transmembrane regions, 41BB cytoplasmic signaling domain, CD3ζ cytoplasmic signaling domain | MALPVTALLLPLALLLHAARPQVQLQESGPGLVKPSETLSLTC TVSDNSISNYYWSWIRQPPGKGLEWIAYIYYSGTTNYNPSLKS RVTISLDTSKNQFSLKLSSVTAADTAVYYCARLFNWGFAFDI WGQGTMVTVSSGGGGSGGGGSGGGGSGGGGSEIVMTQSPAT LSVSPGERATLSCRASQSVSSNLAWYQQKPGQAPRLLIYGAST RATGIPARFSGSGSGTEFTLTISSLQSEDFAVYYCQQYNNWPLT FGGGTKVEIKTTTPAPRPPTPAPTIASQPLSLRPEACRPAAGGA VHTRGLDFACDIYIWAPLAGTCGVLLLSLVITKRGRKKLLYIF KQPFMRPVQTTQEEDGCSCRFPEEEEGGCELRVKFSRSADAPA YQQGQNQLYNELNLGRREEYDVLDKRRGRDPEMGGKPRRK NPQEGLYNELQKDKMAEAYSEIGMKGERRRGKGHDGLYQGL STATKDTYDALHMQALPPR |
| 483 | CD8α signal sequence, 5A2 scFv, CD8α hinge and transmembrane regions, 41BB cytoplasmic signaling domain, CD3ζ cytoplasmic signaling domain | MALPVTALLLPLALLLHAARPQVQLQESGPGLMKPSETLSLTC TVSGGSISSSYWSCIRQPPGKGLEWIGYIYYSGTTNYNPSLKSR VTLSLDTSKNQFSLRLTSVTAADTAVYYCARVAPTgFWFDYW GQGTLVTVSSGGGGSGGGGSGGGGSGGGGSEIVLTQSPGTLS LSPGERATLSCRASQRVSSRYLAWYQQKPGQAPRLLIYGASSR ATGIPDRFSGSGSGTDFTLTISRLEPEEFAVYYCQQYGTSPLTF GGGTKVEIKTTTPAPRPPTPAPTIASQPLSLRPEACRPAAGGAV HTRGLDFACDIYIWAPLAGTCGVLLLSLVITKRGRKKLLYIFK QPFMRPVQTTQEEDGCSCRFPEEEEGGCELRVKFSRSADAPAY QQGQNQLYNELNLGRREEYDVLDKRRGRDPEMGGKPRRKNP QEGLYNELQKDKMAEAYSEIGMKGERRRGKGHDGLYQGLST ATKDTYDALHMQALPPR |
| 484 | CD8α signal sequence, 7F9 scFv, CD8α hinge and transmembrane regions, 41BB cytoplasmic signaling domain, CD3ζ cytoplasmic signaling domain | MALPVTALLLPLALLLHAARPEVQLVESGGGLVQPGGSLRLS CAASGFTFSSHDMHWVRQATGKGLEWVSAIGIAGDTYYSGS VKGRFTISRENAKNSLYLQMNSLRAGDTAVYYCARANWGeG AFDIWGQGTMVTVSSGGGGSGGGGSGGGGSGGGGSDIQMTQ SPSSLSASVGDRVTITCRASQGISDYLAWYQQKPGKIPKLLIYA ASTLQSGVPSRFSGSGSGTDFTLTISSLQPEDVATYYCQKYNSV PLTFGGGTKVEIKTTTPAPRPPTPAPTIASQPLSLRPEACRPAAG GAVHTRGLDFACDIYIWAPLAGTCGVLLLSLVITKRGRKKLLY IFKQPFMRPVQTTQEEDGCSCRFPEEEEGGCELRVKFSRSADA PAYQQGQNQLYNELNLGRREEYDVLDKRRGRDPEMGGKPRR KNPQEGLYNELQKDKMAEAYSEIGMKGERRRGKGHDGLYQ GLSTATKDTYDALHMQALPPR |
| 485 | CD8α signal sequence, 9D3 scFv, CD8α hinge and transmembrane regions, 41BB cytoplasmic | MALPVTALLLPLALLLHAARPQVQLQESGPGLVKPSETLSLTC TVSDDSISNYYWSWIRQPPGKGLEWIGYIFYSGTTNHNPSLKS RLTISLDKAKNQFSLRLSSVTAADTAVYYCARVFNWgFAFDI WGQGTMVTVSSGGGGSGGGGSGGGGSGGGGSEIVLTQSPGT LSLSPGERATLSCRASQRISRTYLAWYQQKPGQAPRLLIYGAS SRATGIPDRFTGSGSGTDFTLTISRLEPEDFAVYYCQQYGTSPL |

TABLE 7-continued

CAR amino acid sequences

| SEQ ID NO: | Name/ Component | Sequence |
|---|---|---|
| | signaling domain, CD3ζ cytoplasmic signaling domain | TFGGGTKVEINTTTPAPRPPTPAPTIASQPLSLRPEACRPAAGG AVHTRGLDFACDIYIWAPLAGTCGVLLLSLVITKRGRKKLLYI FKQPFMRPVQTTQEEDGCSCRFPEEEEGGCELRVKFSRSADAP AYQQGQNQLYNELNLGRREEYDVLDKRRGRDPEMGGKPRR KNPQEGLYNELQKDKMAEAYSEIGMKGERRRGKGHDGLYQ GLSTATKDTYDALHMQALPPR |
| 486 | CD8α signal sequence, 26C8 scFv, CD8α hinge and transmembrane regions, 41BB cytoplasmic signaling domain, CD3ζ cytoplasmic signaling domain | MALPVTALLLPLALLLHAARPQVQLQESGPGLVKPSETLSLTC TVSDNSISNYYWSIRQPPGKGLEWIAYIYYSGTTNYNPSLKS RVTISLDTSKNQFSLQLSSVTAADAAVYYCARVFHWgFAFDI WGQGTMVTVSSGGGGSGGGGSGGGGSGGGGSEIVLTQSPGTL LSLSPGERATLSCRASQRVSNTYLAWYQQNPGQAPRLLIYGAS SRATGIPDRFSGSGSGTDFTLTISRLEPEDFAVYYCQQYGTSPL TFGGGTKVEIKTTTPAPRPPTPAPTIASQPLSLRPEACRPAAGG AVHTRGLDFACDIYIWAPLAGTCGVLLLSLVITKRGRKKLLYI FKQPFMRPVQTTQEEDGCSCRFPEEEEGGCELRVKFSRSADAP AYQQGQNQLYNELNLGRREEYDVLDKRRGRDPEMGGKPRR KNPQEGLYNELQKDKMAEAYSEIGMKGERRRGKGHDGLYQ GLSTATKDTYDALHMQALPPR |
| 487 | CD8α signal sequence, 2A6.C5 scFv, CD8α hinge and transmembrane regions, 41BB cytoplasmic signaling domain, CD3ζ cytoplasmic signaling domain | MALPVTALLLPLALLLHAARPQVQLQESGPGLVKPSETLSLTC TVSNVSISSYYWSIRQPPGKGLEWIGYIYYSGTTNYNPSLKS RVTMSVDTSKNQFSLKLSSVTAADTAVYFCARLSNWgFAFDI WGQGTMVTVSSGGGGSGGGGSGGGGSGGGGSEIVLTQSPGTL SLSPGERATLSCRASQTISSSYLAWYQQKPGQAPRLLIYGASSR ATGIPDRFSGSGSGTEFTLTISRLEPEDFAVYYCQQYGWSPITF GQGTRLEIKTTTPAPRPPTPAPTIASQPLSLRPEACRPAAGGAV HTRGLDFACDIYIWAPLAGTCGVLLLSLVITKRGRKKLLYIFK QPFMRPVQTTQEEDGCSCRFPEEEEGGCELRVKFSRSADAPAY QQGQNQLYNELNLGRREEYDVLDKRRGRDPEMGGKPRRKNP QEGLYNELQKDKMAEAYSEIGMKGERRRGKGHDGLYQGLST ATKDTYDALHMQALPPR |
| 488 | CD8α signal sequence, 5E12 scFv, CD8α hinge and transmembrane regions, 41BB cytoplasmic signaling domain, CD3ζ cytoplasmic signaling domain | MALPVTALLLPLALLLHAARPEVQLVESGGGLVQPGGSLRLS CAASGFTFSSYDMHWVRQATGKGLEWVSAIGPAGDTYYPGS VKGRFTISRENAKNSLYLQMNSLRAGDTAVYYCARADPPyyy YGMDVWGQGTTVTVSSGGGGSGGGGSGGGGSGGGGSDIVM TQSPLSLPVTPGEPASISCRSSQSLLHSNEYNYLDWYLQKPGQS PQLLIYLGSNRASGVPDRFSGSGSGTDFILKISRVEAEDVGVYY CMQALEIPLTFGGGTKVEIKTTTPAPRPPTPAPTIASQPLSLRPE ACRPAAGGAVHTRGLDFACDIYIWAPLAGTCGVLLLSLVITKR GRKKLLYIFKQPFMRPVQTTQEEDGCSCRFPEEEEGGCELRVK FSRSADAPAYQQGQNQLYNELNLGRREEYDVLDKRRGRDPE MGGKPRRKNPQEGLYNELQKDKMAEAYSEIGMKGERRRGK GHDGLYQGLSTATKDTYDALHMQALPPR |
| 489 | CD8α signal sequence, 6D8 scFv, CD8α hinge and transmembrane regions, 41BB cytoplasmic signaling domain, CD3ζ cytoplasmic signaling domain | MALPVTALLLPLALLLHAARPQITLKESGPTLVKPTQTLTLTCT FSGFSLSTrgVGVGWIRQPPGKALEWLALIYWNDDKRYSPSLQ TRLTITKDTPKNQVVLTMTNMDPVDTATYYCARSNWGnWYF ALWGRGTLVTVSSGGGGSGGGGSGGGGSGGGGSEIVLTQSPA TLSLSPGERATLSCRASQSVSSYLAWYQQKPGQAPRLLIYDAF YRATGIPARFSGSGSGTDFTLTISSLEPEDFAVYYCQHRSNWPI TFGQGTRLEIKTTTPAPRPPTPAPTIASQPLSLRPEACRPAAGGA VHTRGLDFACDIYIWAPLAGTCGVLLLSLVITKRGRKKLLYIF KQPFMRPVQTTQEEDGCSCRFPEEEEGGCELRVKFSRSADAPA YQQGQNQLYNELNLGRREEYDVLDKRRGRDPEMGGKPRRK NPQEGLYNELQKDKMAEAYSEIGMKGERRRGKGHDGLYQGL STATKDTYDALHMQALPPR |
| 490 | CD8α signal sequence, 8E11 scFv, CD8α hinge and transmembrane regions, 41BB cytoplasmic signaling domain, CD3ζ cytoplasmic signaling domain | MALPVTALLLPLALLLHAARPQVQLQESGPGLVKPSETLSLTC TVSGDSISNYYWTWIRQPPGKGLEWIGYIYYSGTTNSNPSLKS RVTVSLDTSKSQFSLNLSSVTAADTAVYYCARVFNRgFAFDIW GQGTMVTVSSGGGGSGGGGSGGGGSGGGGSEIVLTQSPGTLS LSPGERATLSCRASQRISNTYLAWYQQKPGQAPRLLIYGASSR ATGIPDRFSGSGSGTDFTLTISRLEPEDFAAYYCQQYDTSPLTF GGGTKVEIKTTTPAPRPPTPAPTIASQPLSLRPEACRPAAGGAV HTRGLDFACDIYIWAPLAGTCGVLLLSLVITKRGRKKLLYIFK QPFMRPVQTTQEEDGCSCRFPEEEEGGCELRVKFSRSADAPAY QQGQNQLYNELNLGRREEYDVLDKRRGRDPEMGGKPRRKNP QEGLYNELQKDKMAEAYSEIGMKGERRRGKGHDGLYQGLST ATKDTYDALHMQALPPR |

TABLE 7-continued

CAR amino acid sequences

| SEQ ID NO: | Name/Component | Sequence |
|---|---|---|
| 491 | CD8α signal sequence, 5C1.A4 scFv, CD8α hinge and transmembrane regions, 41BB cytoplasmic signaling domain, CD3ζ cytoplasmic signaling domain | MALPVTALLLPLALLLHAARPQVTLRESGPALVKPTQTLTLTC TVSGVSLSTsgMCVSWIRQPLGKALEWLGFIDWDDDKYYNTS LKTRLTISKDTSKNQVVLTMTNMDPVDTATYYCARIRGYsgsy DAFDIWGQGTVVIVSSGGGGSGGGGSGGGGSGGGGSDIVMT QSPLSLPVTPGEPASISCRSSQSLLHSNGYNHLDWYLQKPGQSP QVLIYLGSNRASGVPDRFSGSGSGTDFTLKISRVEAEDVGVYF CMQALQTPLTFGGGTKVEIKTTTPAPRPPTPAPTIASQPLSLRP EACRPAAGGAVHTRGLDFACDIYIWAPLAGTCGVLLLSLVITK RGRKKLLYIFKQPFMRPVQTTQEEDGCSCRFPEEEEGGCELRV KFSRSADAPAYQQGQNQLYNELNLGRREEYDVLDKRRGRDP EMGGKPRRKNPQEGLYNELQKDKMAEAYSEIGMKGERRRGK GHDGLYQGLSTATKDTYDALHMQALPPR |
| 492 | CD8α signal sequence, 9F7 scFv, CD8α hinge and transmembrane regions, 41BB cytoplasmic signaling domain, CD3ζ cytoplasmic signaling domain | MALPVTALLLPLALLLHAARPQVQLVSGPGLVKPSETLSLTC SVSGGSISSYYWSWIRQSPGKGLDWIGYMYYSGTTNYNPSLK SRVTISVDTSKNQFSLKLSSVTATDTAVYYCARVGLTgFFFDY WGQGTLVTVSSGGGGSGGGGSGGGGSGGGGSAIQMTQSPSSL SASVGDRVTITCRASQGIRNDLGWYQQKPGKAPKLLIYAASSL QSGVPSRFSGSGSGTDFTLTVSSLQPEDFATYYCLQDYNYPYT FGQGTKLEIKTTTPAPRPPTPAPTIASQPLSLRPEACRPAAGGA VHTRGLDFACDIYIWAPLAGTCGVLLLSLVITKRGRKKLLYIF KQPFMRPVQTTQEEDGCSCRFPEEEEGGCELRVKFSRSADAPA YQQGQNQLYNELNLGRREEYDVLDKRRGRDPEMGGKPRRK NPQEGLYNELQKDKMAEAYSEIGMKGERRRGKGHDGLYQGL STATKDTYDALHMQALPPR |
| 493 | CD8α signal sequence, 2C3 scFv, CD8α hinge and transmembrane regions, 41BB cytoplasmic signaling domain, CD3ζ cytoplasmic signaling domain | MALPVTALLLPLALLLHAARPQVQLQQWGGGLLKPSETLSLT CAVYGGSSSGNYWSWIRQPPGKRLEWIGEINHSGTTSYNPSLK SRVTISVDTSKNQFSLKLSSVTAADTAVYYCARGELGIADSWG QGTLVTVSSGGGGSGGGGSGGGGSGGGGSDIQMTQSPSTLSA SVGDRVTITCRASQSISRWLAWYQQKPGKAPKLLIYKASSLES GVPSRFSGSGSGTEFTLTISSLQPDDFATYYCQQYNSYSTFGQG TKVEIKTTTPAPRPPTPAPTIASQPLSLRPEACRPAAGGAVHTR GLDFACDIYIWAPLAGTCGVLLLSLVITKRGRKKLLYIFKQPF MRPVQTTQEEDGCSCRFPEEEEGGCELRVKFSRSADAPAYQQ GQNQLYNELNLGRREEYDVLDKRRGRDPEMGGKPRRKNPQE GLYNELQKDKMAEAYSEIGMKGERRRGKGHDGLYQGLSTAT KDTYDALHMQALPPR |
| 494 | CD8α signal sequence, 2G1 scFv, CD8α hinge and transmembrane regions, 41BB cytoplasmic signaling domain, CD3ζ cytoplasmic signaling domain | MALPVTALLLPLALLLHAARPQLQLQESGPGLVKPSETLSLTC TVSGGSISSssYYWGWIRQPPGKGLEWIGSIYYSGNIYHNPSLK SRVSISVDTSKNQFSLRLSSVTAADTAVYYCAREIIVgaTHFDY WGQGTLVTVSSGGGGSGGGGSGGGGSGGGGSAIQMTQSPSSL SASVGDRVTITCRASQGIRNDLGWYQQKPGKAPELLIYAASSL QSGVPSRFSGSGSGTDFTLTISSLQPEDFATYYCLQDYNPLTF GPGTKVDIKTTTPAPRPPTPAPTIASQPLSLRPEACRPAAGGAV HTRGLDFACDIYIWAPLAGTCGVLLLSLVITKRGRKKLLYIFK QPFMRPVQTTQEEDGCSCRFPEEEEGGCELRVKFSRSADAPAY QQGQNQLYNELNLGRREEYDVLDKRRGRDPEMGGKPRRKNP QEGLYNELQKDKMAEAYSEIGMKGERRRGKGHDGLYQGLST ATKDTYDALHMQALPPR |
| 495 | CD8α signal sequence, 3E4 scFv, CD8α hinge and transmembrane regions, 41BB cytoplasmic signaling domain, CD3ζ cytoplasmic signaling domain | MALPVTALLLPLALLLHAARPQVQLQQWGAGLLKPSETLSLT CAVYGGSFSGYYWSWIRQPPGKGLEWIGEIIHSGSSNYNPSLK SRVSISVDTSKNQFSLKLSSVTAADTAVYYCSRGEYGsgsSRFDY WGQGTLVTVSSGGGGSGGGGSGGGGSGGGGSAIQMTQSPSSL SASVGDRVAITCRASQGIRDDLGWYQQKPGKAPKLLIYAASS LQSGVPSRFSGSRSDTDFTLTISSLQPEDFATYYCLQDYDYPLT FGGGTKVEIKTTTPAPRPPTPAPTIASQPLSLRPEACRPAAGGA VHTRGLDFACDIYIWAPLAGTCGVLLLSLVITKRGRKKLLYIF KQPFMRPVQTTQEEDGCSCRFPEEEEGGCELRVKFSRSADAPA YQQGQNQLYNELNLGRREEYDVLDKRRGRDPEMGGKPRRK NPQEGLYNELQKDKMAEAYSEIGMKGERRRGKGHDGLYQGL STATKDTYDALHMQALPPR |
| 496 | CD8α signal sequence, 3F2 scFv, CD8α hinge and transmembrane regions, 41BB cytoplasmic | MALPVTALLLPLALLLHAARPQVQLESGPGLVKPSGTLSLTC AVSGGSISSnNWWSWVRQPPGKGLEWIGDIHHSGSTNYKPSL KSRVTISVDKSKNQFSLNLISVTAADTAVYYCAREAGGYFDY WGQGILVTVSSGGGGSGGGGSGGGGSGGGGSDIQMTQSPSTL SASVGDRVTITCRASQSISSWLAWYQQKPGKAPKLLISKASSL ESGVPSRFSGSGSGPEFTLTISSLQPADFATYYCQQYNSYSTFG |

TABLE 7-continued

CAR amino acid sequences

| SEQ ID NO: | Name/Component | Sequence |
|---|---|---|
| | signaling domain, CD3ζ cytoplasmic signaling domain | QGTKLEIKTTTPAPRPPTPAPTIASQPLSLRPEACRPAAGGAVH TRGLDFACDIYIWAPLAGTCGVLLLSLVITKRGRKKLLYIFKQP FMRPVQTTQEEDGCSCRFPEEEEGGCELRVKFSRSADAPAYQ QGQNQLYNELNLGRREEYDVLDKRRGRDPEMGGKPRRKNPQ EGLYNELQKDKMAEAYSEIGMKGERRRGKGHDGLYQGLSTA TKDTYDALHMQALPPR |
| 497 | CD8α signal sequence, 4F9 scFv, CD8α hinge and transmembrane regions, 41BB cytoplasmic signaling domain, CD3ζ cytoplasmic signaling domain | MALPVTALLLPLALLLHAARPQVQLQQWGAGLLKPSETLSLT CAVYGGSFSGYYWTWIRQPPGKGLEWIGEITHSGSTNYNPSL KSRVSISVDTSKNQFSLKLSSVTAADTAVYYCARGEYGsgSRF DYWGQGTLVTVSSGGGGSGGGGSGGGGSAIQMTQSP SSLSASVGDRVAITCRASQGIRDDLGWYQQKPGKAPKLLIYA ASSLQSGVPSRFSGSGSDTDFTLTISSLQPEDFATYYCLQDYDY PLTFGGGTKVEIKTTTPAPRPPTPAPTIASQPLSLRPEACRPAAG GAVHTRGLDFACDIYIWAPLAGTCGVLLLSLVITKRGRKKLLY IFKQPFMRPVQTTQEEDGCSCRFPEEEEGGCELRVKFSRSADA PAYQQGQNQLYNELNLGRREEYDVLDKRRGRDPEMGGKPRR KNPQEGLYNELQKDKMAEAYSEIGMKGERRRGKGHDGLYQ GLSTATKDTYDALHMQALPPR |
| 498 | CD8α signal sequence, 4G9 scFv, CD8α hinge and transmembrane regions, 41BB cytoplasmic signaling domain, CD3ζ cytoplasmic signaling domain | MALPVTALLLPLALLLHAARPQVQLQQWGAGLLKPSETLSLT CAVYGGSFSGYYWSWIRQPPGKGLEWIGEITHSGSTNYNPSLK SRVSISVDTSKNQFSLKLSSVTAADTAVYYCARGEYGsgSRFD YWGQGTLVTVSSGGGGSGGGGSGGGGSGGGGSAIQMTQSP SLSASVGDRVALTCRASQGIRDDLGWYQQKPGKAPKLLIYAA SSLQSGVPSRFSGSGSDTDFTLTISSLQPEDFATYYCLQDYDYP LTFGGGTKVEIKTTTPAPRPPTPAPTIASQPLSLRPEACRPAAG GAVHTRGLDFACDIYIWAPLAGTCGVLLLSLVITKRGRKKLLY IFKQPFMRPVQTTQEEDGCSCRFPEEEEGGCELRVKFSRSADA PAYQQGQNQLYNELNLGRREEYDVLDKRRGRDPEMGGKPRR KNPQEGLYNELQKDKMAEAYSEIGMKGERRRGKGHDGLYQ GLSTATKDTYDALHMQALPPR |
| 499 | CD8α signal sequence, 11H7 scFv, CD8α hinge and transmembrane regions, 41BB cytoplasmic signaling domain, CD3ζ cytoplasmic signaling domain | MALPVTALLLPLALLLHAARPQVQLQQWGAGLLKPSETLSLT CAVYGGSFSAYYWNWIRQPPGKGLEWIGEINHSGSTNYNPSL KSRVTISVDTSKNQFSLNLTSLTAADTAVYYCARGLDSsgwYP FDYWGQGTLVTVSSGGGGSGGGGSGGGGSGGGGSDIQMTQS PSSVSASVGDRVTITCRASQGISSWLAWYQQKPGKAPKLLIYA ASSLQSGVPSRFSGSGSGTDFTLTISSLQPEDFATYYCQQADSF PFTFGPGTKVDIKTTTPAPRPPTPAPTIASQPLSLRPEACRPAAG GAVHTRGLDFACDIYIWAPLAGTCGVLLLSLVITKRGRKKLLY IFKQPFMRPVQTTQEEDGCSCRFPEEEEGGCELRVKFSRSADA PAYQQGQNQLYNELNLGRREEYDVLDKRRGRDPEMGGKPRR KNPQEGLYNELQKDKMAEAYSEIGMKGERRRGKGHDGLYQ GLSTATKDTYDALHMQALPPR |
| 500 | CD8α signal sequence, 16H7 scFv, CD8α hinge and transmembrane regions, 41BB cytoplasmic signaling domain, CD3ζ cytoplasmic signaling domain | MALPVTALLLPLALLLHAARPQVQLQQWGAGLLKPSETLSLT CAVFGGSFSGDYWSWIRQPPGKGLEWIGEINHSGITSFNPSLKS RVTISVDTSKNQFSLKLSSVTAADTAVYYCARGELGIPDNWG QGTLVTVSSGGGGSGGGGSGGGGSGGGGSDIQMTQSPSTLSA SVGDRVTITCRASQSISRWLAWYQQKPGKAPKLLIYKASSLES GVPSRFSGSGSGTEFTLTISSLQPDDFATYYCQQYNSYSTFGQG TKVEIKTTTPAPRPPTPAPTIASQPLSLRPEACRPAAGGAVHTR GLDFACDIYIWAPLAGTCGVLLLSLVITKRGRKKLLYIFKQPF MRPVQTTQEEDGCSCRFPEEEEGGCELRVKFSRSADAPAYQQ GQNQLYNELNLGRREEYDVLDKRRGRDPEMGGKPRRKNPQE GLYNELQKDKMAEAYSEIGMKGERRRGKGHDGLYQGLSTAT KDTYDALHMQALPPR |
| 501 | CD8α signal sequence, 17A2 scFv, CD8α hinge and transmembrane regions, 41BB cytoplasmic signaling domain, CD3ζ cytoplasmic signaling domain | MALPVTALLLPLALLLHAARPQVQLESGPGLVKPSGTLSLTC VVFGDSISSsNWWSWVRQPPGKGLEWIGEVFHSGSTNYNPSL KSRVTISVDKSKNQFSLKLSSVTAADTAVYYCARAAVAGALD YWGQGTLVTVSSGGGGSGGGGSGGGGSGGGGSDIVMTQSPD SLAVSLGERATINCKSSQSVLYSSNNKNYLAWYQQKPGQPPN LLVYWASTRESGVPDRFSGAGSGTDFTLTISSLQAEDVAVYYC QQYYGTSWTFGQGTKVEIKTTTPAPRPPTPAPTIASQPLSLRPE ACRPAAGGAVHTRGLDFACDIYIWAPLAGTCGVLLLSLVITKR GRKKLLYIFKQPFMRPVQTTQEEDGCSCRFPEEEEGGCELRVK FSRSADAPAYQQGQNQLYNELNLGRREEYDVLDKRRGRDPE MGGKPRRKNPQEGLYNELQKDKMAEAYSEIGMKGERRRGK GHDGLYQGLSTATKDTYDALHMQALPPR |

TABLE 7-continued

CAR amino acid sequences

| SEQ ID NO: | Name/Component | Sequence |
|---|---|---|
| 502 | CD8α signal sequence, 6H1 scFv, CD8α hinge and transmembrane regions, 41BB cytoplasmic signaling domain, CD3ζ cytoplasmic signaling domain | MALPVTALLLPLALLLHAARPQITLRESGPTLVKPTQTLTLTCT FSGFSLSTsgLGVGWIRQPPGEALEWLALIYWNDDKRYSPSLK SRLSITKDTSKNQVVLIMTNMDPVDTATYYCVHRRIAaPGSVY WGQGTLVTVSSGGGGSGGGGSGGGGSGGGGSDIQMTQSPSS VSASVGDRVTITCRASQGISSWLAWYQQKPGKAPKLLISAASS LQSGVPSRFSGSGSGTDFTLTISSLQPEDFATYYCHQANSFPFT FGQGTKLEIKTTTPAPRPPTPAPTIASQPLSLRPEACRPAAGGA VHTRGLDFACDIYIWAPLAGTCGVLLLSLVITKRGRKKLLYIF KQPFMRPVQTTQEEDGCSCRFPEEEEGGCELRVKFSRSADAPA YQQGQNQLYNELNLGRREEYDVLDKRRGRDPEMGGKPRRK NPQEGLYNELQKDKMAEAYSEIGMKGERRRGKGHDGLYQGL STATKDTYDALHMQALPPR |
| 503 | CD8α signal sequence, 6H5 scFv, CD8α hinge and transmembrane regions, 41BB cytoplasmic signaling domain, CD3ζ cytoplasmic signaling domain | MALPVTALLLPLALLLHAARPQVQLVQSGAEVKKPGASVKVS CKVSGYTLTELSMHWVRQAPGKGPEGMGGFDpEDGKTIYAQ KFQGRVTMTEDTSADTAYMELNSLRSEDTAVYYCATLLRG1D AFDVWGQGTMVTVSSGGGGSGGGGSGGGGSGGGGSDIQMT QSPSSLSASVGDRVTITCRASQGIRNDLGWYQQKPGKAPKRLI YAASSLQSGVPSRFSGSGSGTEFTLTISTLQPEDFATYYCLQHN SYPRTFGQGTKVEIKTTTPAPRPPTPAPTIASQPLSLRPEACRPA AGGAVHTRGLDFACDIYIWAPLAGTCGVLLLSLVITKRGRKK LLYIFKQPFMRPVQTTQEEDGCSCRFPEEEEGGCELRVKFSRS ADAPAYQQGQNQLYNELNLGRREEYDVLDKRRGRDPEMGG KPRRKNPQEGLYNELQKDKMAEAYSEIGMKGERRRGKGHDG LYQGLSTATKDTYDALHMQALPPR |
| 504 | CD8α signal sequence, 10D1 scFv, CD8α hinge and transmembrane regions, 41BB cytoplasmic signaling domain, CD3ζ cytoplasmic signaling domain | MALPVTALLLPLALLLHAARPQVQLQQWGAGLLKPSETLSLT CAVYGGSFSGYYWRWIRQPPGKGLEWIGEISHSGSTNYNPSL KSRVTISVDTSKNQFSLKLSSVTAADTAVYYCAVRGYSygyPLF DYWGQGTLVTVSSGGGGSGGGGSGGGGSGGGGSDIQMTQSP SSLSASVGDRVTITCRASQGIRNDLGWYQQKLGKAPKRLIYA ASSLQSGVPSRFSGSGSGTEFTLTISSLQPEDFATYYCLQYNSY PRTFGQGTKVEIKTTTPAPRPPTPAPTIASQPLSLRPEACRPAAG GAVHTRGLDFACDIYIWAPLAGTCGVLLLSLVITKRGRKKLLY IFKQPFMRPVQTTQEEDGCSCRFPEEEEGGCELRVKFSRSADA PAYQQGQNQLYNELNLGRREEYDVLDKRRGRDPEMGGKPRR KNPQEGLYNELQKDKMAEAYSEIGMKGERRRGKGHDGLYQ GLSTATKDTYDALHMQALPPR |
| 505 | CD8α signal sequence, 11F6 scFv, CD8α hinge and transmembrane regions, 41BB cytoplasmic signaling domain, CD3ζ cytoplasmic signaling domain | MALPVTALLLPLALLLHAARPQVQLQESGPGLVKPSGTLSLTC AVSGDSISSNWWTWVRQPPGKGLEWIGDIHHSGSTNYNPSLK SRVTMSVDKSENQFSLKLSSVTAADTAVFYCARDGGGTLDY WGQGTLVTVSSGGGGSGGGGSGGGGSGGGGSDIQMTQSPST LSASVGDRVTITCRASQSISSWLAWYQQKPGKAPKLLIYKAST LESGVPSRFSGSGSGTEFTLTISSLQPDDFATYYCQQYNGYSTF GQGTKVEIKTTTPAPRPPTPAPTIASQPLSLRPEACRPAAGGAV HTRGLDFACDIYIWAPLAGTCGVLLLSLVITKRGRKKLLYIFK QPFMRPVQTTQEEDGCSCRFPEEEEGGCELRVKFSRSADAPAY QQGQNQLYNELNLGRREEYDVLDKRRGRDPEMGGKPRRKNP QEGLYNELQKDKMAEAYSEIGMKGERRRGKGHDGLYQGLST ATKDTYDALHMQALPPR |
| 506 | CD8α signal sequence, 6F8 scFv, CD8α hinge and transmembrane regions, 41BB cytoplasmic signaling domain, CD3ζ cytoplasmic signaling domain | MALPVTALLLPLALLLHAARPQVQLVQSGAEVKKPGSSVKVS CKASGGTFTNYCISWVRQAPGQGLEWMGGIIpIFGTTNYAQTF QGRVTITADKSTSTAYMELSSLRSEDTAVYYCARDNGDryyYD MDVWGQGTTVTVSSGGGGSGGGGSGGGGSGGGGSQSVLTQP PSVSAAPGQKVTISCSGSSSNIGNNYVSWYQQLPGTAPKLLIY DNNKRPSGIPDRFSGSKSGTSATLGITGLQTGDEADYYCGTWD SSLSAVVFGGGTKLTVLTTTPAPRPPTPAPTIASQPLSLRPEACR PAAGGAVHTRGLDFACDIYIWAPLAGTCGVLLLSLVITKRGR KKLLYIFKQPFMRPVQTTQEEDGCSCRFPEEEEGGCELRVKFS RSADAPAYQQGQNQLYNELNLGRREEYDVLDKRRGRDPEMG GKPRRKNPQEGLYNELQKDKMAEAYSEIGMKGERRRGKGHD GLYQGLSTATKDTYDALHMQALPPR |
| 507 | CD8α signal sequence, 3G6-L1 scFv, CD8α hinge and transmembrane regions, 41BB cytoplasmic | MALPVTALLLPLALLLHAARPQVPLVQSGAEVKKPGSSVKVS CKASGGTFSTYSISWVRQAPGQGLEWMGGIIpIFGTTNYAQKF QGRVTITADKSTSTAYMELSSLRSEDTAVYYCARDGEGsyyyy YGMDVWGQGTTVTVSSGGGGSGGGGSGGGGSGGGGSQSVL TQPPSVSAAPGQKVTISCSGSSSNIGNNYVSWYQQLPGTAPKL LIYDNNKRPSGIPDRFFGSKFGTSATLGITGLQTGDEADYYCGT |

TABLE 7-continued

CAR amino acid sequences

| SEQ ID NO: | Name/Component | Sequence |
|---|---|---|
| | signaling domain, CD3ζ cytoplasmic signaling domain | WDSSLSAVVFGGGTKLTVLTTTPAPRPPTPAPTIASQPLSLRPE ACRPAAGGAVHTRGLDFACDIYIWAPLAGTCGVLLLSLVITKR GRKKLLYIFKQPFMRPVQTTQEEDGCSCRFPEEEEGGCELRVK FSRSADAPAYQQGQNQLYNELNLGRREEYDVLDKRRGRDPE MGGKPRRKNPQEGLYNELQKDKMAEAYSEIGMKGERRRGK GHDGLYQGLSTATKDTYDALHMQALPPR |
| 508 | CD8α signal sequence, 4C6 scFv, CD8α hinge and transmembrane regions, 41BB cytoplasmic signaling domain, CD3ζ cytoplasmic signaling domain | MALPVTALLLPLALLLHAARPQVQLQESGPGLVKPSETLSLTC TVSGDSISSYYWSWIRQPPGKGLEWIGYMYYSGITNYNPSLKS RVNISLDTSKNQFSLKLGSVTAADTAVYYCARLSVAgFYFDY WGQGTLVTVSSGGGGSGGGGSGGGGSGGGGSEIVLTQSPGTL SLSPGERATLSCRASQSVTRSYLAWYQQKPGQAPRLLIYGASS RATDIPDRFSGSGSGTDFTLTINRLEPEDFAVYYCQQYGTSPLT FGGGTKVEIKTTTPAPRPPTPAPTIASQPLSLRPEACRPAAGGA VHTRGLDFACDIYIWAPLAGTCGVLLLSLVITKRGRKKLLYIF KQPFMRPVQTTQEEDGCSCRFPEEEEGGCELRVKFSRSADAPA YQQGQNQLYNELNLGRREEYDVLDKRRGRDPEMGGKPRRK NPQEGLYNELQKDKMAEAYSEIGMKGERRRGKGHDGLYQGL STATKDTYDALHMQALPPR |
| 509 | CD8α signal sequence, 4E6 scFv, CD8α hinge and transmembrane regions, 41BB cytoplasmic signaling domain, CD3ζ cytoplasmic signaling domain | MALPVTALLLPLALLLHAARPQVQLQESGPGLVKPSETLSLTC TVSSDSISSYYWSWIRQPPGKGLEWISYIYYSGISNYNPSLKSR VSISVDTSKNQFSLRLSSVTAADTAVYYCARISVAgFFFDNWG QGTLVTVSSGGGGSGGGGSGGGGSGGGGSEIMLTQSPDTLSL SPGERATLSCRASQSVSSSYLAWYQQKPGQAPRLLIYGASSRA AGVPDRFSGSGSGTDFTLTISRLAPEDFVVYYCQQYGISPLTFG GGTKVEIKTTTPAPRPPTPAPTIASQPLSLRPEACRPAAGGAVH TRGLDFACDIYIWAPLAGTCGVLLLSLVITKRGRKKLLYIFKQP FMRPVQTTQEEDGCSCRFPEEEEGGCELRVKFSRSADAPAYQ QGQNQLYNELNLGRREEYDVLDKRRGRDPEMGGKPRRKNPQ EGLYNELQKDKMAEAYSEIGMKGERRRGKGHDGLYQGLSTA TKDTYDALHMQALPPR |
| 510 | CD8α signal sequence, 4H8 scFv, CD8α hinge and transmembrane regions, 41BB cytoplasmic signaling domain, CD3ζ cytoplasmic signaling domain | MALPVTALLLPLALLLHAARPQVQLQQSGPGLVKPSQTLSLTC AISGDSVSSnsATWNWIRQSPSRGLEWLGRTYYRSKwyDDYAV SVKSRITINPDTSKNHLSLHLNSVTPEDTAVYYCAGGGLVgapD GFDVWGQGTMVTVSSGGGGSGGGGSGGGGSGGGGSQSVLT QPPSASGTPGQRVTISCSGSSSNIGSDPVNWYQQLPGTAPKLLI YSNNQRPSGVPDRFSGSKSGTSASLAISGLQSEDEADYYCSAW DDSLNGYVFGTGTKVTVLTTTPAPRPPTPAPTIASQPLSLRPEA CRPAAGGAVHTRGLDFACDIYIWAPLAGTCGVLLLSLVITKRG RKKLLYIFKQPFMRPVQTTQEEDGCSCRFPEEEEGGCELRVKF SRSADAPAYQQGQNQLYNELNLGRREEYDVLDKRRGRDPEM GGKPRRKNPQEGLYNELQKDKMAEAYSEIGMKGERRRGKGH DGLYQGLSTATKDTYDALHMQALPPR |
| 511 | CD8α signal sequence, 9H12-K scFv, CD8α hinge and transmembrane regions, 41BB cytoplasmic signaling domain, CD3ζ cytoplasmic signaling domain | MALPVTALLLPLALLLHAARPQVQLVQSGAEVKKPGASVKVS CKASGYTFTGYSIHWVRQAPGQGLEWMGWINpNSGGTFYAQ KFQGRVTMTRDTSISTVYMELSRLRSDDTAVYYCARDGWGdy yyYGLDVWGQGTTVTVSLGGGGSGGGGSGGGGSGGGGSDIQ MTQSPSSVSASVGDRVTITCRASQDISSWLAWYQQKPGKAPK LLIYTASSLQGGVPSRFSGSGSGTDFTLTISSLQPEDLATYSCQQ ANVFPYTFGQGTKLEIKTTTPAPRPPTPAPTIASQPLSLRPEACR PAAGGAVHTRGLDFACDIYIWAPLAGTCGVLLLSLVITKRGR KKLLYIFKQPFMRPVQTTQEEDGCSCRFPEEEEGGCELRVKFS RSADAPAYQQGQNQLYNELNLGRREEYDVLDKRRGRDPEMG GKPRRKNPQEGLYNELQKDKMAEAYSEIGMKGERRRGKGHD GLYQGLSTATKDTYDALHMQALPPR |
| 512 | CD8α signal sequence, 10G1-K scFv, CD8α hinge and transmembrane regions, 41BB cytoplasmic signaling domain, CD3ζ cytoplasmic signaling domain | MALPVTALLLPLALLLHAARPEVQLLESGGGLVQPGGSLRLSC AASGFTFSSYAMNWVRQAPGKGLEWVSTISgSGGSTYYADSV KGRFTISRDNSKNTLYLQMNSLRAEDTAVFYCAIDPEYydilTG GDYWGQGTLVTVSSGGGGSGGGGSGGGGSGGGGSDIQMT QSPSAMSASVGDRVTITCRASQGISNYLAWFQQKPGKVPKRLI YAASSLQSGVPSRFSGSGSGTEFTLTISSLQPEDFATYFCLQHD SFPLTFGGGTKVEIKTTTPAPRPPTPAPTIASQPLSLRPEACRPA AGGAVHTRGLDFACDIYIWAPLAGTCGVLLLSLVITKRGRKK LLYIFKQPFMRPVQTTQEEDGCSCRFPEEEEGGCELRVKFSRS ADAPAYQQGQNQLYNELNLGRREEYDVLDKRRGRDPEMGG KPRRKNPQEGLYNELQKDKMAEAYSEIGMKGERRRGKGHDG LYQGLSTATKDTYDALHMQALPPR |

TABLE 7-continued

CAR amino acid sequences

| SEQ ID NO: | Name/Component | Sequence |
|---|---|---|
| 513 | CD8α signal sequence, 11A3 scFv, CD8α hinge and transmembrane regions, 41BB cytoplasmic signaling domain, CD3ζ cytoplasmic signaling domain | MALPVTALLLPLALLLHAARPQVQLQESGPGLVKPSETLSLTC TVSSDSISNYYWSWIRQPPGKGLEWISYIYYSGITNYNPSLKSR VTISVDTSKNQFSLKLSSVTAADTAVYYCARITVTgFYFDYWG QGTLVTVSSGGGGSGGGGSGGGGSGGGGSEIVLTQSPGTLSLS PGERATLSCRASQSISRSYLAWYQQKPGQAPRHLIYGASSRAT GIPDRFSGSGSGTDFILTISRLEPEDFAVYYCQQYDTSPLTFGG GTKVEIKTTTPAPRPPTPAPTIASQPLSLRPEACRPAAGGAVHT RGLDFACDIYIWAPLAGTCGVLLLSLVITKRGRKKLLYIFKQPF MRPVQTTQEEDGCSCRFPEEEEGGCELRVKFSRSADAPAYQQ GQNQLYNELNLGRREEYDVLDKRRGRDPEMGGKPRRKNPQE GLYNELQKDKMAEAYSEIGMKGERRRGKGHDGLYQGLSTAT KDTYDALHMQALPPR |
| 514 | CD8α signal sequence, 3B11 scFv, CD8α hinge and transmembrane regions, 41BB cytoplasmic signaling domain, CD3ζ cytoplasmic signaling domain | MALPVTALLLPLALLLHAARPQVQLQQSGPGLVKPSQTLSLTC AISGDSVSSnsVVWNWIRQSPSRGLEWLGRTYYRSKwyDDYA VSVKSRITINPDTSKNQFSLQLNSVTPEDTAVYHCARGGIVgap DAFDIWGQGTMVTVSSGGGGSGGGGSGGGGSGGGGSQSVLT QPPSASGTPGQRVTISCSGSSSNIGSDPVSWYQQFPGTAPKLLI YTNNQRPSGVPDRFSGSKSGTSASLAISGLQSEDEADYYCAA WDDSLNGHVFGTGTKVTVLTTTPAPRPPTPAPTIASQPLSLRPE ACRPAAGGAVHTRGLDFACDIYIWAPLAGTCGVLLLSLVITKR GRKKLLYIFKQPFMRPVQTTQEEDGCSCRFPEEEEGGCELRVK FSRSADAPAYQQGQNQLYNELNLGRREEYDVLDKRRGRDPE MGGKPRRKNPQEGLYNELQKDKMAEAYSEIGMKGERRRGK GHDGLYQGLSTATKDTYDALHMQALPPR |
| 515 | CD8α signal sequence, 5G2 scFv, CD8α hinge and transmembrane regions, 41BB cytoplasmic signaling domain, CD3ζ cytoplasmic signaling domain | MALPVTALLLPLALLLHAARPQVQLQQSGPGLVKPSQTLSLTC AISGDSVSSnsAVWNWIRQSPSRGLEWLGWTYYRSKYYndYA VSLKSRITINPDTSKNQFSLQLNSLTPEDTAVYYCTRGGIVgapD GFDIWGQGTMVTVSSGGGGSGGGGSGGGGSGGGGSQSALTQ PPSASGTPGQRVTISCSGSNSNIGSNPINWYQQLPGTAPKLLIYS NNQRPSGVPDRFSGSKSGTSASLAISGLQSEDEADYYCAAWD DSLNGHVFGTGTKVTVLTTTPAPRPPTPAPTIASQPLSLRPEAC RPAAGGAVHTRGLDFACDIYIWAPLAGTCGVLLLSLVITKRGR KKLLYIFKQPFMRPVQTTQEEDGCSCRFPEEEEGGCELRVKFS RSADAPAYQQGQNQLYNELNLGRREEYDVLDKRRGRDPEMG GKPRRKNPQEGLYNELQKDKMAEAYSEIGMKGERRRGKGHD GLYQGLSTATKDTYDALHMQALPPR |
| 516 | CD8α signal sequence, 11E4 scFv, CD8α hinge and transmembrane regions, 41BB cytoplasmic signaling domain, CD3ζ cytoplasmic signaling domain | MALPVTALLLPLALLLHAARPQVQLQESGPGLVKPSETLSLTC TVSGGSISSYYWSWIRQSPGKGLEWIGYVYYSDITNYNPSLKS RVTISVDTSKNQFSLNLNSVTAADTAFYFCARIGVAgFYFDYW GQGTLVTVSSGGGGSGGGGSGGGGSGGGGSEIVLTQSPDTLS LSPGERATLSCRASQSVSRRYLAWYQQKPGQAPRLLIYGASSR ATGIPDRFSGSGSGTDFTLTISRLEPEDFEVYYCQQYGTSPITFG QGTRLEIKTTTPAPRPPTPAPTIASQPLSLRPEACRPAAGGAVH TRGLDFACDIYIWAPLAGTCGVLLLSLVITKRGRKKLLYIFKQP FMRPVQTTQEEDGCSCRFPEEEEGGCELRVKFSRSADAPAYQ QGQNQLYNELNLGRREEYDVLDKRRGRDPEMGGKPRRKNPQ EGLYNELQKDKMAEAYSEIGMKGERRRGKGHDGLYQGLSTA TKDTYDALHMQALPPR |
| 517 | CD8α signal sequence, 2404.8E11 scFv, CD8α hinge and transmembrane regions, 41BB cytoplasmic signaling domain, CD3ζ cytoplasmic signaling domain | MALPVTALLLPLALLLHAARPQIQLQQSGPGLVKPSQTLSLTC AISGDSVSSnsAVWNWIRQSPSRGLEWLGRTYYRSKwyNDYA VSVKSRITIKPDTAKNQFSLNLSVTPEDTAVYYFTRGGIVgap DAFDIWGQGTMVTVSSGGGGSGGGGSGGGGSGGGGSQSVLT QPPSASGTPGQRVTISCSGSSSNIGSDPINWYQQVPGTAPKLLI YSNNQRPSGVPDRFSGSKSGTSASLAISGLQSEDEADYYCAA WDDSLNGYVFGTGTKVTVLTTTPAPRPPTPAPTIASQPLSLRPE ACRPAAGGAVHTRGLDFACDIYIWAPLAGTCGVLLLSLVITKR GRKKLLYIFKQPFMRPVQTTQEEDGCSCRFPEEEEGGCELRVK FSRSADAPAYQQGQNQLYNELNLGRREEYDVLDKRRGRDPE MGGKPRRKNPQEGLYNELQKDKMAEAYSEIGMKGERRRGK GHDGLYQGLSTATKDTYDALHMQALPPR |
| 518 | CD8α signal sequence, 10A2 scFv, CD8α hinge and transmembrane regions, 41BB cytoplasmic | MALPVTALLLPLALLLHAARPQVQLQQSGPGLVKPSETLSLTC AISGDSVSSnsATWNWIRQSPSRGLEWLGRTYYRSEwyNDYAV SVKSRITINPDTSKNHLSLHLNSVTPEDTAVYYCAGGGIVgapD GFDVWGQGTMVTVSSGGGGSGGGGSGGGGSGGGGSQSVLT QPPSASGTPGQRVTISCSGSSSNIGSDPVIWYQQLPRTAPKLLIY SNNQRPSGVPDRFSGSKSGTSASLAISGLQSEDEADYYCAAW |

TABLE 7-continued

CAR amino acid sequences

| SEQ ID NO: | Name/Component | Sequence |
|---|---|---|
| | signaling domain, CD3ζ cytoplasmic signaling domain | DDSLNGYVFGTGTKVTVLTTTPAPRPPTPAPTIASQPLSLRPEA CRPAAGGAVHTRGLDFACDIYIWAPLAGTCGVLLLSLVITKRG RKKLLYIFKQPFMRPVQTTQEEDGCSCRFPEEEEGGCELRVKF SRSADAPAYQQGQNQLYNELNLGRREEYDVLDKRRGRDPEM GGKPRRKNPQEGLYNELQKDKMAEAYSEIGMKGERRRGKGH DGLYQGLSTATKDTYDALHMQALPPR |
| 519 | CD8α signal sequence, 11A8 scFv, CD8α hinge and transmembrane regions, 41BB cytoplasmic signaling domain, CD3ζ cytoplasmic signaling domain | MALPVTALLLPLALLLHAARPQVQLQQSGPGLVKPSQTLSLTC AISGDSVSSnsATWNWIRQSPSTGLEWLARTYYRSKwyNDYEV SVKSQITINPDTSKNQFSLQLNSVTPEDTAVYYCARGGIVgapD AFDIWGQGTMVTVSSGGGGSGGGGSGGGGSGGGGSQSVLTQ PPSASGTPGQGVTISCSGSSSNIGSNPVNWYQQLPGTAPKLLIY SNNQRPSGVPDRFSDSKSGTSASLAISGLQSEDEADYYCSAWD DWLNGYVFGTGTKVTVLTTTPAPRPPTPAPTIASQPLSLRPEA CRPAAGGAVHTRGLDFACDIYIWAPLAGTCGVLLLSLVITKRG RKKLLYIFKQPFMRPVQTTQEEDGCSCRFPEEEEGGCELRVKF SRSADAPAYQQGQNQLYNELNLGRREEYDVLDKRRGRDPEM GGKPRRKNPQEGLYNELQKDKMAEAYSEIGMKGERRRGKGH DGLYQGLSTATKDTYDALHMQALPPR |
| 520 | CD8α signal sequence, 4H5 scFv, CD8α hinge and transmembrane regions, 41BB cytoplasmic signaling domain, CD3ζ cytoplasmic signaling domain | MALPVTALLLPLALLLHAARPQVQLQESGPGLVKPSETLSLTC TVSGDSINNYFWSWIRQPPGKGLEWIGYFYHRGGNNYNPSLK SRVTISIDTSKNQFSLNLNSVTSADTAVYYCARLALAgFFFDY WGQGTLVTVSSGGGGSGGGGSGGGGSGGGGSDIQMTQSPST LSASVGDRVTITCRASQSISSWLAWYQQKPGKAPKLLIYKASS LESGVPSRFSGSGSGTEFTLTISSLQPDDFATYYCQQYNSYSRT FGQGTKVEIKTTTPAPRPPTPAPTIASQPLSLRPEACRPAAGGA VHTRGLDFACDIYIWAPLAGTCGVLLLSLVITKRGRKKLLYIF KQPFMRPVQTTQEEDGCSCRFPEEEEGGCELRVKFSRSADAPA YQQGQNQLYNELNLGRREEYDVLDKRRGRDPEMGGKPRRK NPQEGLYNELQKDKMAEAYSEIGMKGERRRGKGHDGLYQGL STATKDTYDALHMQALPPR |
| 521 | CD8α signal sequence, 3G6-L2 scFv, CD8α hinge and transmembrane regions, 41BB cytoplasmic signaling domain, CD3ζ cytoplasmic signaling domain | MALPVTALLLPLALLLHAARPQVPLVQSGAEVKKPGSSVKVS CKASGGTFSTYSISWVRQAPGQGLEWMGGIIpIFGTTNYAQKF QGRVTITADKSTSTAYMELSSLRSEDTAVYYCARDGEGsyyyy YGMDVWGQGTTVTVSSGGGGSGGGGSGGGGSGGGGSQSVL TQPPSASGTPGQRVTISCSGSSSNIGSNYVYWYQQLPGTAPKL LIYSNNQRPSGVPDRFSGSKSGTSASLAISGLRSEDEADYYCAA WDDSLSGWVFGGGTKLTVLTTTPAPRPPTPAPTIASQPLSLRPE ACRPAAGGAVHTRGLDFACDIYIWAPLAGTCGVLLLSLVITKR GRKKLLYIFKQPFMRPVQTTQEEDGCSCRFPEEEEGGCELRVK FSRSADAPAYQQGQNQLYNELNLGRREEYDVLDKRRGRDPE MGGKPRRKNPQEGLYNELQKDKMAEAYSEIGMKGERRRGK GHDGLYQGLSTATKDTYDALHMQALPPR |
| 522 | CD8α signal sequence, 3B9 scFv, CD8α hinge and transmembrane regions, 41BB cytoplasmic signaling domain, CD3ζ cytoplasmic signaling domain | MALPVTALLLPLALLLHAARPEVQLVESGGGLVQPGGSLRLS CAASGFTFSSYSMNWVRQAPGKGLEWVSYISsSSSTIYYADSV KGRFTISRDNAKNSLYLQMNSLRDEDTAVYYCARDKERryyyY GMDVWGQGTTVTVSSGGGGSGGGGSGGGGSGGGGSEIVLTQ SPDTLSLSPGERATLSCRASQSVSRRYLAWYQQKPGQAPRLLI YGASSRATGIPDRFSGSGSGTDFTLTISRLEPEDFAVYYCQQFG TSPITFGQGTRLEIKTTTPAPRPPTPAPTIASQPLSLRPEACRPAA GGAVHTRGLDFACDIYIWAPLAGTCGVLLLSLVITKRGRKKLL YIFKQPFMRPVQTTQEEDGCSCRFPEEEEGGCELRVKFSRSAD APAYQQGQNQLYNELNLGRREEYDVLDKRRGRDPEMGGKPR RKNPQEGLYNELQKDKMAEAYSEIGMKGERRRGKGHDGLYQ GLSTATKDTYDALHMQALPPR |
| 523 | CD8α signal sequence, 3F9-L scFv, CD8α hinge and transmembrane regions, 41BB cytoplasmic signaling domain, CD3ζ cytoplasmic signaling domain | MALPVTALLLPLALLLHAARPQVQLQQSGPGLVKPSQTLSLA CAISGDSVSSnsAIWNWIRQSPSRGLEWLGGTYYRSMwyNDYA VSVKSRITINPDTSKNQLSLQLNSVTPEDTAVYYCSRGGIVgvp DAFDIWGQGTMVTVSSGGGGSGGGGSGGGGSGGGGSQSVLT QPPSASGTPGQRVTISCSGSSSNIGSNTANWYQQLPGTAPRLLI YRNNQRPSGVPDRFSGSKSGTSASLAISGLQSEDEADYYCAA WDDSLNGYVFGTGTKVTVLTTTPAPRPPTPAPTIASQPLSLRPE ACRPAAGGAVHTRGLDFACDIYIWAPLAGTCGVLLLSLVITKR GRKKLLYIFKQPFMRPVQTTQEEDGCSCRFPEEEEGGCELRVK FSRSADAPAYQQGQNQLYNELNLGRREEYDVLDKRRGRDPE MGGKPRRKNPQEGLYNELQKDKMAEAYSEIGMKGERRRGK GHDGLYQGLSTATKDTYDALHMQALPPR |

TABLE 7-continued

CAR amino acid sequences

| SEQ ID NO: | Name/Component | Sequence |
|---|---|---|
| 524 | CD8α signal sequence, 3E10 scFv, CD8α hinge and transmembrane regions, 41BB cytoplasmic signaling domain, CD3ζ cytoplasmic signaling domain | MALPVTALLLPLALLLHAARPQVQLQESGPGLVKPSETLSLTC NVSDGSISSYYWTWIRQPPGKGLDWIGYIFYSGTTNYNPSLKS RVTISLDTSKNQFSLKLTSMTAADTAVYYCARISEKsFYFDYW GQGTLVTVSSGGGGSGGGGSGGGGSGGGGSQSVLTQPPSASG TPGQRVTISCSGSSSNIGSNYVYWYQQLPGTAPKLLIYSNNQR PSGVPDRFSGSKSGTSASLAISGLRSEDEADYYCAPWDDSLSG RVFGGGTKLTVLTTTPAPRPPTPAPTIASQPLSLRPEACRPAAG GAVHTRGLDFACDIYIWAPLAGTCGVLLLSLVITKRGRKKLLY IFKQPFMRPVQTTQEEDGCSCRFPEEEEGGCELRVKFSRSADA PAYQQGQNQLYNELNLGRREEYDVLDKRRGRDPEMGGKPRR KNPQEGLYNELQKDKMAEAYSEIGMKGERRRGKGHDGLYQ GLSTATKDTYDALHMQALPPR |
| 525 | CD8α signal sequence, 3C3 scFv, CD8α hinge and transmembrane regions, 41BB cytoplasmic signaling domain, CD3ζ cytoplasmic signaling domain | MALPVTALLLPLALLLHAARPQVQLVQSGAEVKRPGASVKVS CKASGYTFTSYYIHWVRQAPGQGLEWMGVIVpSGGSISYAQK FQGRVTMTRDTSTNIVYMELSSLRSEDTAVYYCARDRYYgdyy YGLDVWGQGTTVTVSSGGGGSGGGGSGGGGSGGGGSDIQMT QSPSSLSASVGDRVTITCRASQGINNFLAWFQQKPGKAPKSLIY AASSLQSGVPSKFSGSGSGTDFTLTIRSLQPEDFATYYCQHYNS YPITFGQGTRLEIKTTTPAPRPPTPAPTIASQPLSLRPEACRPAA GGAVHTRGLDFACDIYIWAPLAGTCGVLLLSLVITKRGRKKLL YIFKQPFMRPVQTTQEEDGCSCRFPEEEEGGCELRVKFSRSAD APAYQQGQNQLYNELNLGRREEYDVLDKRRGRDPEMGGKPR RKNPQEGLYNELQKDKMAEAYSEIGMKGERRRGKGHDGLYQ GLSTATKDTYDALHMQALPPR |
| 526 | CD8α signal sequence, 11F4 scFv, CD8α hinge and transmembrane regions, 41BB cytoplasmic signaling domain, CD3ζ cytoplasmic signaling domain | MALPVTALLLPLALLLHAARPQVHLQESGPGLVKPSETLSLTC TVSGGSISHYYWTWIRQPPGKGLEWIGYIYYSGITNFSPSLKSR VSISVDSSKNQFSLNLNSVTAADTAVYYCAGISLAgFYFDYWV QGTLVTVSSGGGGSGGGGSGGGGSGGGGSEIVLTQSPGTLSLS PGERATLSCRASQSVSRSYLAWYQQKPGQAPRLLIYGASSRAT GVPDRFSGSGSGTDFTLTISRLEPEDFAVFYCQQYSISPLTFGG GTKVEIKTTTPAPRPPTPAPTIASQPLSLRPEACRPAAGGAVHT RGLDFACDIYIWAPLAGTCGVLLLSLVITKRGRKKLLYIFKQPF MRPVQTTQEEDGCSCRFPEEEEGGCELRVKFSRSADAPAYQQ GQNQLYNELNLGRREEYDVLDKRRGRDPEMGGKPRRKNPQE GLYNELQKDKMAEAYSEIGMKGERRRGKGHDGLYQGLSTAT KDTYDALHMQALPPR |
| 527 | CD8α signal sequence, 10E12 scFv, CD8α hinge and transmembrane regions, 41BB cytoplasmic signaling domain, CD3ζ cytoplasmic signaling domain | MALPVTALLLPLALLLHAARPQVQLQESGPGLVKPSETLSLTC TVSGVSISSYYWSWIRQPPGKGLEWIAYIYYSGNTNYSPSLKS RVTISVDTSKDQLSLKLSSVTAADTAVYYCTRGGSGtiDVFDIW GQGTMVAVSSGGGGSGGGGSGGGGSGGGGSQSVLTQPPSVS AAPGQKVTISCSGSSSNIGNNYVSWYQQLPGTAPKLLIYDNNK RPSGIPDRFSGSKSGTSATLGITGLQTGDEADYYCETWDSSLSA VVFGGGTKLTVLTTTPAPRPPTPAPTIASQPLSLRPEACRPAAG GAVHTRGLDFACDIYIWAPLAGTCGVLLLSLVITKRGRKKLLY IFKQPFMRPVQTTQEEDGCSCRFPEEEEGGCELRVKFSRSADA PAYQQGQNQLYNELNLGRREEYDVLDKRRGRDPEMGGKPRR KNPQEGLYNELQKDKMAEAYSEIGMKGERRRGKGHDGLYQ GLSTATKDTYDALHMQALPPR |
| 528 | CD8α signal sequence, 4E1 scFv, CD8α hinge and transmembrane regions, 41BB cytoplasmic signaling domain, CD3ζ cytoplasmic signaling domain | MALPVTALLLPLALLLHAARPQVQLQQSGPGLVKPSQTLSLTC AISGDNVSTnsAAWNWIRQSPSRGLEWLGWTYYRSKwyNDYA VSLKSRININPDTSKNQFSLQLNSVTPEDTAVYYCARWVNRD VFDIWGQGTMVTVSSGGGGSGGGGSGGGGSGGGGSQSALTQ PASVSGSPGQSITISCTGTSSDVGSYNLVSWYQQHPGKAPKLM IYEGSKRPSGVSNRFSGSKSGNTASLTISGLQAEDEADYYCC    S YAGSSTWVFGGGTKLTVLTTTPAPRPPTPAPTIASQPLSRPEA CRPAAGGAVHTRGLDFACDIYIWAPLAGTCGVLLLSLVITKRG RKKLLYIFKQPFMRPVQTTQEEDGCSCRFPEEEEGGCELRVKF SRSADAPAYQQGQNQLYNELNLGRREEYDVLDKRRGRDPEM GGKPRRKNPQEGLYNELQKDKMAEAYSEIGMKGERRRGKGH DGLYQGLSTATKDTYDALHMQALPPR |
| 529 | CD8α signal sequence, 2404.6H1 scFv, CD8α hinge and transmembrane regions, 41BB cytoplasmic | MALPVTALLLPLALLLHAARPQVQLVESGGGVVQPGRSLRLS CAASGFTFSSYGMHWVRQTPGKGLEWVAVISYDGNsNYYAD SVKGRFTISRDNSKNTLYLQMNSLRAEDTAVYYCARDGATvts yyyYGMDVWGQGTTVTVSSGGGGSGGGGSGGGGSGGGGSEI VLTQSPGTLSLSPGERATLSCRASQSVSRTYLAWYHQKPGQAP RLLIYGASSRATGISDRFSGSGSGTDFTLTISRLEPEDFAVYYCQ |

TABLE 7-continued

CAR amino acid sequences

| SEQ ID NO: | Name/Component | Sequence |
|---|---|---|
| | signaling domain, CD3ζ cytoplasmic signaling domain | QYGTSPITFGQGTRLEIKTTTPAPRPPTPAPTIASQPLSLRPEAC RPAAGGAVHTRGLDFACDIYIWAPLAGTCGVLLLSLVITKRGR KKLLYIFKQPFMRPVQTTQEEDGCSCRFPEEEEGGCELRVKFS RSADAPAYQQGQNQLYNELNLGRREEYDVLDKRRGRDPEMG GKPRRKNPQEGLYNELQKDKMAEAYSEIGMKGERRRGKGHD GLYQGLSTATKDTYDALHMQALPPR |
| 530 | CD8α signal sequence, 2A8 scFv, CD8α hinge and transmembrane regions, 41BB cytoplasmic signaling domain, CD3ζ cytoplasmic signaling domain | MALPVTALLLPLALLLHAARPQVQLQQSGPGLVKPSQTLSLTC AISGDSVSSnsAVWNWIRQSPSRGLEWLGRTYYRSKwyNDYA VSVKSRITINPDTSRNQFSLQLNSVTPEDTAVYYCARGGIVgap DGFDIWGQGTMVTVSSGGGGSGGGGSGGGGSGGGGSDIVMT QSPDSLAVSLGERATINCKSSQSVLDSSNNNnYFAWYQQRPGQ PPHLLIYWASSRESGVPDRFSGSGSGTDFTLTISSLQAEDVAVY YCQQYYSTPYTFGQGTKLEIKTTTPAPRPPTPAPTIASQPLSLRP EACRPAAGGAVHTRGLDFACDIYIWAPLAGTCGVLLLSLVITK RGRKKLLYIFKQPFMRPVQTTQEEDGCSCRFPEEEEGGCELRV KFSRSADAPAYQQGQNQLYNELNLGRREEYDVLDKRRGRDP EMGGKPRRKNPQEGLYNELQKDKMAEAYSEIGMKGERRRGK GHDGLYQGLSTATKDTYDALHMQALPPR |
| 531 | CD8α signal sequence, 3B1 scFv, CD8α hinge and transmembrane regions, 41BB cytoplasmic signaling domain, CD3ζ cytoplasmic signaling domain | MALPVTALLLPLALLLHAARPQVQLQQSGPGLVKPSQTLSLTC AISGDSVSSntTAWKWSRQSPSKGLEWLGWTYYRSKwyYDYT VSVKSRITINPDTSKNQFSLQLNSVTPEDTAVYYCARWIFHDA FDIWGQGTMVTVSSGGGGSGGGGSGGGGSGGGGSQSALTQP PSASGTPGQRVTISCSGSSSNIGSNTVNWYQQLPGTAPKLLIYT NNQRPSGVPDRFSGSKSGTSASLAISGLQSEDEADYFCSTWDD SLNGPVFGGGTKLTVLTTTPAPRPPTPAPTIASQPLSLRPEACRP AAGGAVHTRGLDFACDIYIWAPLAGTCGVLLLSLVITKRGRK KLLYIFKQPFMRPVQTTQEEDGCSCRFPEEEEGGCELRVKFSR SADAPAYQQGQNQLYNELNLGRREEYDVLDKRRGRDPEMGG KPRRKNPQEGLYNELQKDKMAEAYSEIGMKGERRRGKGHDG LYQGLSTATKDTYDALHMQALPPR |
| 532 | CD8α signal sequence, 9B5 scFv, CD8α hinge and transmembrane regions, 41BB cytoplasmic signaling domain, CD3ζ cytoplasmic signaling domain | MALPVTALLLPLALLLHAARPQVQLQESGPGLVKPSETLSLTC TVSGDSISSLSWSWIRQTPGEGLEWIGYLYYSGSTDYNPSLKS RVTISVDTSKNQFSLKLRSVAAADTALYYCARGRRAFDIWGQ GTMVTVSSGGGGSGGGGSGGGGSGGGGSDIQMTQSPSSLSAS VGDRVTITCRGSQGISNYLAWFQQRPGKAPKSLIYAASSLESG VPSKFSGSGSGTDFTLTIISLQPEDFATYYCQQYYNYPITFGQG TRLEIKTTTPAPRPPTPAPTIASQPLSLRPEACRPAAGGAVHTR GLDFACDIYIWAPLAGTCGVLLLSLVITKRGRKKLLYIFKQPF MRPVQTTQEEDGCSCRFPEEEEGGCELRVKFSRSADAPAYQQ GQNQLYNELNLGRREEYDVLDKRRGRDPEMGGKPRRKNPQE GLYNELQKDKMAEAYSEIGMKGERRRGKGHDGLYQGLSTAT KDTYDALHMQALPPR |
| 533 | CD8α signal sequence, 11A5 scFv, CD8α hinge and transmembrane regions, 41BB cytoplasmic signaling domain, CD3ζ cytoplasmic signaling domain | MALPVTALLLPLALLLHAARPQVQLVQSGAEVKKPGASVKVS CKASGYTFTGYYMHWVRQAPGQGLEWMGWINpNSGGTNYA QKFQGRVTMTRDTSVSTAYMELSRLTSDDTAIYYCAKDGGGd fyfYGMDVWGQGTTVTVSSGGGGSGGGGSGGGGSGGGGSQT VVTQEPSFSVSPGGTVTLTCGLSSGSVSTSYYPSCFQQTPGQAP RTLIYSTDTRSSGVPDRFSGSILGNKAALTITGAQADDESDYYC VLYMGSGISVFGGGTKLTVLTTTPAPRPPTPAPTIASQPLSLRP EACRPAAGGAVHTRGLDFACDIYIWAPLAGTCGVLLLSLVITK RGRKKLLYIFKQPFMRPVQTTQEEDGCSCRFPEEEEGGCELRV KFSRSADAPAYQQGQNQLYNELNLGRREEYDVLDKRRGRDP EMGGKPRRKNPQEGLYNELQKDKMAEAYSEIGMKGERRRGK GHDGLYQGLSTATKDTYDALHMQALPPR |
| 632 | CD8α signal sequence, 2D3 scFv, CD8α hinge and transmembrane regions, 41BB cytoplasmic signaling domain, CD3ζ cytoplasmic signaling domain | MALPVTALLLPLALLLHAARPQVQLQESGPGLVKPSETLSLTC TVSDNSISNYYWSWIRQPPGKGLEWIAYIYYSGTTNYNPSLKS RVTISLDTSKNQFSLKLSSVTAADTAVYYCARLFNWGFAFDI WGQGTMVTVSSGGGGSGGGGSGGGGSGGGGSEIVMTQSPAT LSVSPGERATLSCRASQSVSSNLAWYQQKPGQAPRLLIYGAST RATGIPARFSGSGSGTEFTLTISSLQSEDFAVYYCQQYNNWPLT FGGGTKVEIKTTTPAPRPPTPAPTIASQPLSLRPEACRPAAGGA VHTRGLDFACDIYIWAPLAGTCGVLLLSLVITLYCKRGRKKLL YIFKQPFMRPVQTTQEEDGCSCRFPEEEEGGCELRVKFSRSAD APAYQQGQNQLYNELNLGRREEYDVLDKRRGRDPEMGGKPR RKNPQEGLYNELQKDKMAEAYSEIGMKGERRRGKGHDGLYQ GLSTATKDTYDALHMQALPPR |

TABLE 7-continued

CAR amino acid sequences

| SEQ ID NO: | Name/Component | Sequence |
|---|---|---|
| 633 | CD8α signal sequence, 5A2 scFv, CD8α hinge and transmembrane regions, 41BB cytoplasmic signaling domain, CD3ζ cytoplasmic signaling domain | MALPVTALLLPLALLLHAARPQVQLQESGPGLMKPSETLSLTC TVSGGSISSSYWSCIRQPPGKGLEWIGYIYYSGTTNYNPSLKSR VTLSLDTSKNQFSLRLTSVTAADTAVYYCARVAPTgFWFDYW GQGTLVTVSSGGGGSGGGGSGGGGSGGGGSEIVLTQSPGTLS LSPGERATLSCRASQRVSSRYLAWYQQKPGQAPRLLIYGASSR ATGIPDRFSGSGSGTDFTLTISRLEPEEFAVYYCQQYGTSPLTF GGGTKVEIKTTTPAPRPPTPAPTIASQPLSLRPEACRPAAGGAV HTRGLDFACDIYIWAPLAGTCGVLLLSLVITLYCKRGRKKLLY IFKQPFMRPVQTTQEEDGCSCRFPEEEEGGCELRVKFSRSADA PAYQQGQNQLYNELNLGRREEYDVLDKRRGRDPEMGGKPRR KNPQEGLYNELQKDKMAEAYSEIGMKGERRRGKGHDGLYQ GLSTATKDTYDALHMQALPPR |
| 634 | CD8α signal sequence, 7F9 scFv, CD8α hinge and transmembrane regions, 41BB cytoplasmic signaling domain, CD3ζ cytoplasmic signaling domain | MALPVTALLLPLALLLHAARPEVQLVESGGGLVQPGGSLRLS CAASGFTFSSHDMHWVRQATGKGLEWVSAIGIAGDTYYSGS VKGRFTISRENAKNSLYLQMNSLRAGDTAVYYCARANWGeG AFDIWGQGTMVTVSSGGGGSGGGGSGGGGSGGGGSDIQMTQ SPSSLSASVGDRVTITCRASQGISDYLAWYQQKPGKIPKLLIYA ASTLQSGVPSRFSGSGSGTDFTLTISSLQPEDVATYYCQKYNSV PLTFGGGTKVEIKTTTPAPRPPTPAPTIASQPLSLRPEACRPAAG GAVHTRGLDFACDIYIWAPLAGTCGVLLLSLVITLYCKRGRK KLLYIFKQPFMRPVQTTQEEDGCSCRFPEEEEGGCELRVKFSR SADAPAYQQGQNQLYNELNLGRREEYDVLDKRRGRDPEMGG KPRRKNPQEGLYNELQKDKMAEAYSEIGMKGERRRGKGHDG LYQGLSTATKDTYDALHMQALPPR |
| 635 | CD8α signal sequence, 9D3 scFv, CD8α hinge and transmembrane regions, 41BB cytoplasmic signaling domain, CD3ζ cytoplasmic signaling domain | MALPVTALLLPLALLLHAARPQVQLQESGPGLVKPSETLSLTC TVSDDSISNYYWSWIRQPPGKGLEWIGYIFYSGTTNHNPSLKS RLTISLDKAKNQFSLRLSSVTAADTAVYYCARVFNWgFAFDI WGQGTMVTVSSGGGGSGGGGSGGGGSGGGGSEIVLTQSPGT LSLSPGERATLSCRASQRISRTYLAWYQQKPGQAPRLLIYGAS SRATGIPDRFTGSGSGTDFTLTISRLEPEDFAVYYCQQYGTSPL TFGGGTKVEINTTTPAPRPPTPAPTIASQPLSLRPEACRPAAGG AVHTRGLDFACDIYIWAPLAGTCGVLLLSLVITLYCKRGRKKL LYIFKQPFMRPVQTTQEEDGCSCRFPEEEEGGCELRVKFSRSA DAPAYQQGQNQLYNELNLGRREEYDVLDKRRGRDPEMGGKP RRKNPQEGLYNELQKDKMAEAYSEIGMKGERRRGKGHDGLY QGLSTATKDTYDALHMQALPPR |
| 636 | CD8α signal sequence, 26C8 scFv, CD8α hinge and transmembrane regions, 41BB cytoplasmic signaling domain, CD3ζ cytoplasmic signaling domain | MALPVTALLLPLALLLHAARPQVQLQESGPGLVKPSETLSLTC TVSDNSISNYYWSWIRQPPGKGLEWIAYIYYSGTTNYNPSLKS RVTISLDTSKNQFSLQLSSVTAADAAVYYCARVFHWgFAFDI WGQGTMVTVSSGGGGSGGGGSGGGGSGGGGSEIVLTQSPGT LSLSPGERATLSCRASQRVSNTYLAWYQQNPGQAPRLLIYGAS SRATGIPDRFSGSGSGTDFTLTISRLEPEDFAVYYCQQYGTSPL TFGGGTKVEIKTTTPAPRPPTPAPTIASQPLSLRPEACRPAAGG AVHTRGLDFACDIYIWAPLAGTCGVLLLSLVITLYCKRGRKKL LYIFKQPFMRPVQTTQEEDGCSCRFPEEEEGGCELRVKFSRSA DAPAYQQGQNQLYNELNLGRREEYDVLDKRRGRDPEMGGKP RRKNPQEGLYNELQKDKMAEAYSEIGMKGERRRGKGHDGLY QGLSTATKDTYDALHMQALPPR |
| 637 | CD8α signal sequence, 2A6.C5 scFv, CD8α hinge and transmembrane regions, 41BB cytoplasmic signaling domain, CD3ζ cytoplasmic signaling domain | MALPVTALLLPLALLLHAARPQVQLQESGPGLVKPSETLSLTC TVSNVSISSYYWSWIRQPPGKGLEWIGYIYYSGTTNYNPSLKS RVTMSVDTSKNQFSLKLSSVTAADTAVYFCARLSNWgFAFDI WGQGTMVTFSSGGGGSGGGGSGGGGSGGGGSEIVLTQSPGTL SLSPGERATLSCRASQTISSSYLAWYQQKPGQAPRLLIYGASSR ATGIPDRFSGSGSGTEFTLTISRLEPEDFAVYYCQQYGWSPITF GQGTRLEIKTTTPAPRPPTPAPTIASQPLSLRPEACRPAAGGAV HTRGLDFACDIYIWAPLAGTCGVLLLSLVITLYCKRGRKKLLY IFKQPFMRPVQTTQEEDGCSCRFPEEEEGGCELRVKFSRSADA PAYQQGQNQLYNELNLGRREEYDVLDKRRGRDPEMGGKPRR KNPQEGLYNELQKDKMAEAYSEIGMKGERRRGKGHDGLYQ GLSTATKDTYDALHMQALPPR |
| 638 | CD8α signal sequence, 5E12 scFv, CD8α hinge and transmembrane regions, 41BB | MALPVTALLLPLALLLHAARPEVQLVESGGGLVQPGGSLRLS CAASGFTFSSYDMHWVRQATGKGLEWVSAIGPAGDTYYPGS VKGRFTISRENAKNSLYLQMNSLRAGDTAVYYCARADPPyyy YGMDVWGQGTTVTVSSGGGGSGGGGSGGGGSGGGGSDIVM TQSPSLPVTPGEPASISCRSSQSLLHSNEYNYLDWYLQKPGQS |

TABLE 7-continued

CAR amino acid sequences

| SEQ ID NO: | Name/Component | Sequence |
|---|---|---|
| | cytoplasmic signaling domain, CD3ζ cytoplasmic signaling domain | PQLLIYLGSNRASGVPDRFSGSGSGTDFILKISRVEAEDVGVYY CMQALEIPLTFGGGTKVEIKTTTPAPRPPTPAPTIASQPLSLRPE ACRPAAGGAVHTRGLDFACDIYIWAPLAGTCGVLLLSLVITLY CKRGRKKLLYIFKQPFMRPVQTTQEEDGCSCRFPEEEEGGCEL RVKFSRSADAPAYQQGQNQLYNELNLGRREEYDVLDKRRGR DPEMGGKPRRKNPQEGLYNELQKDKMAEAYSEIGMKGERRR GKGHDGLYQGLSTATKDTYDALHMQALPPR |
| 639 | CD8α signal sequence, 6D8 scFv, CD8α hinge and transmembrane regions, 41BB cytoplasmic signaling domain, CD3ζ cytoplasmic signaling domain | MALPVTALLLPLALLLHAARPQITLKESGPTLVKPTQTLTLTCT FSGFSLSTrgVGVGWIRQPPGKALEWLALIYWNDDKRYSPSLQ TRLTITKDTPKNQVVLTMTNMDPVDTATYYCARSNWGnWYF ALWGRGTLVTVSSGGGGSGGGGSGGGGSGGGGSEIVLTQSPA TLSLSPGERATLSCRASQSVSSYLAWYQQKPGQAPRLLIYDAF YRATGIPARFSGSGSGTDFTLTISSLEPEDFAVYYCQHRSNWPI TFGQGTRLEIKTTTPAPRPPTPAPTIASQPLSLRPEACRPAAGGA VHTRGLDFACDIYIWAPLAGTCGVLLLSLVITLYCKRGRKKLL YIFKQPFMRPVQTTQEEDGCSCRFPEEEEGGCELRVKFSRSAD APAYQQGQNQLYNELNLGRREEYDVLDKRRGRDPEMGGKPR RKNPQEGLYNELQKDKMAEAYSEIGMKGERRRGKGHDGLYQ GLSTATKDTYDALHMQALPPR |
| 640 | CD8α signal sequence, 8E11 scFv, CD8α hinge and transmembrane regions, 41BB cytoplasmic signaling domain, CD3ζ cytoplasmic signaling domain | MALPVTALLLPLALLLHAARPQVQLQESGPGLVKPSETLSLTC TVSGDSISNYYWTWIRQPPGKGLEWIGYIYYSGTTNSNPSLKS RVTVSLDTSKSQFSLNLSSVTAADTAVYYCARVFNRgFAFDIW GQGTMVTVSSGGGGSGGGGSGGGGSGGGGSEIVLTQSPGTLS LSPGERATLSCRASQRISNTYLAWYQQKPGQAPRLLIYGASSR ATGIPDRFSGSGSGTDFTLTISRLEPEDFAAYYCQQYDTSPLTF GGGTKVEIKTTTPAPRPPTPAPTIASQPLSLRPEACRPAAGGAV HTRGLDFACDIYIWAPLAGTCGVLLLSLVITLYCKRGRKKLLY IFKQPFMRPVQTTQEEDGCSCRFPEEEEGGCELRVKFSRSADA PAYQQGQNQLYNELNLGRREEYDVLDKRRGRDPEMGGKPRR KNPQEGLYNELQKDKMAEAYSEIGMKGERRRGKGHDGLYQ GLSTATKDTYDALHMQALPPR |
| 641 | CD8α signal sequence, 5C1.A4 scFv, CD8α hinge and transmembrane regions, 41BB cytoplasmic signaling domain, CD3ζ cytoplasmic signaling domain | MALPVTALLLPLALLLHAARPQVTLRESGPALVKPTQTLTLTC TVSGVSLSTsgMCVSWIRQPLGKALEWLGFIDWDDDKYYNTS LKTRLTISKDTSKNQVVLTMTNMDPVDTATYYCARIRGYsgsy DAFDIWGQGTVVIVSSGGGGSGGGGSGGGGSGGGGSDIVMT QSPLSLPVTPGEPASISCRSSQSLLHSNGYNHLDWYLQKPGQSP QVLIYLGSNRASGVPDRFSGSGSGTDFTLKISRVEAEDVGVYF CMQALQTPLTFGGGTKVEIKTTTPAPRPPTPAPTIASQPLSLRP EACRPAAGGAVHTRGLDFACDIYIWAPLAGTCGVLLLSLVITL YCKRGRKKLLYIFKQPFMRPVQTTQEEDGCSCRFPEEEEGGCE LRVKFSRSADAPAYQQGQNQLYNELNLGRREEYDVLDKRRG RDPEMGGKPRRKNPQEGLYNELQKDKMAEAYSEIGMKGERR RGKGHDGLYQGLSTATKDTYDALHMQALPPR |
| 642 | CD8α signal sequence, 9F7 scFv, α hinge and transmembrane regions, 41BB cytoplasmic signaling domain, CD3ζ cytoplasmic signaling domain | MALPVTALLLPLALLLHAARPQVQLQVSGPGLVKPSETLSLTC SVSGGSISSYYWSWIRQSPGKGLDWIGYMYYSGTTNYNPSLK SRVTISVDTSKNQFSLKLSSVTATDTAVYYCARVGLTgFFFDY WGQGTLVTVSSGGGGSGGGGSGGGGSGGGGSAIQMTQSPSSL SASVGDRVTITCRASQGIRNDLGWYQQKPGKAPKLLIYAASSL QSGVPSRFSGSGSGTDFTLTVSSLQPEDFATYYCLQDYNYPYT FGQGTKLEIKTTTPAPRPPTPAPTIASQPLSLRPEACRPAAGGA VHTRGLDFACDIYIWAPLAGTCGVLLLSLVITLYCKRGRKKLL YIFKQPFMRPVQTTQEEDGCSCRFPEEEEGGCELRVKFSRSAD APAYQQGQNQLYNELNLGRREEYDVLDKRRGRDPEMGGKPR RKNPQEGLYNELQKDKMAEAYSEIGMKGERRRGKGHDGLYQ GLSTATKDTYDALHMQALPPR |
| 643 | CD8α signal sequence, 2C3 scFv, CD8α hinge and transmembrane regions, 41BB cytoplasmic signaling domain, CD3ζ cytoplasmic signaling domain | MALPVTALLLPLALLLHAARPQVQLQQWGGGLLKPSETLSLT CAVYGGSSSGNYWSWIRQPPGKRLEWIGEINHSGTTSYNPSLK SRVTISVDTSKNQFSLKLSSVTAADTAVYYCARGELGIADSWG QGTLVTVSSGGGGSGGGGSGGGGSGGGGSDIQMTQSPSTLSA SVGDRVTITCRASQSISRWLAWYQQKPGKAPKLLIYKASSLES GVPSRFSGSGSGTEFTLTISSLQPDDFATYYCQQYNSYSTFGQG TKVEIKTTTPAPRPPTPAPTIASQPLSLRPEACRPAAGGAVHTR GLDFACDIYIWAPLAGTCGVLLLSLVITLYCKRGRKKLLYIFK QPFMRPVQTTQEEDGCSCRFPEEEEGGCELRVKFSRSADAPAY QQGQNQLYNELNLGRREEYDVLDKRRGRDPEMGGKPRRKNP QEGLYNELQKDKMAEAYSEIGMKGERRRGKGHDGLYQGLST ATKDTYDALHMQALPPR |

TABLE 7-continued

CAR amino acid sequences

| SEQ ID NO: | Name/Component | Sequence |
|---|---|---|
| 644 | CD8α signal sequence, 2G1 scFv, CD8α hinge and transmembrane regions, 41BB cytoplasmic signaling domain, CD3ζ cytoplasmic signaling domain | MALPVTALLLPLALLLHAARPQLQLQESGPGLVKPSETLSLTC TVSGGSISSssYYWGWIRQPPGKGLEWIGSIYYSGNIYHNPSLK SRVSISVDTSKNQFSLRLSSVTAADTAVYYCAREIIVgaTHFDY WGQGTLVTVSSGGGGSGGGGSGGGGSGGGGSAIQMTQSPSSL SASVGDRVTITCRASQGIRNDLGWYQQKPGKAPELLIYAASSL QSGVPSRFSGSGSGTDFTLTISSLQPEDFATYYCLQDYNYPLTF GPGTKVDIKTTTPAPRPPTPAPTIASQPLSLRPEACRPAAGGAV HTRGLDFACDIYIWAPLAGTCGVLLLSLVITLYCKRGRKKLLY IFKQPFMRPVQTTQEEDGCSCRFPEEEEGGCELRVKFSRSADA PAYQQGQNQLYNELNLGRREEYDVLDKRRGRDPEMGGKPRR KNPQEGLYNELQKDKMAEAYSEIGMKGERRRGKGHDGLYQ GLSTATKDTYDALHMQALPPR |
| 645 | CD8α signal sequence, 3E4 scFv, CD8α hinge and transmembrane regions, 41BB cytoplasmic signaling domain, CD3ζ cytoplasmic signaling domain | MALPVTALLLPLALLLHAARPQVQLQQWGAGLLKPSETLSLT CAVYGGSFSGYYWSWIRQPPGKGLEWIGEIIHSGSSNYNPSLK SRVSISVDTSKNQFSLKLSSVTAADTAVYYCSRGEYGsgSRFDY WGQGTLVTVSSGGGGSGGGGSGGGGSGGGGSAIQMTQSPSSL SASVGDRVAITCRASQGIRDDLGWYQQKPGKAPKLLIYAASS LQSGVPSRFSGSRSDTDFTLTISSLQPEDFATYYCLQDYDYPLT FGGGGTKVEIKTTTPAPRPPTPAPTIASQPLSLRPEACRPAAGGA VHTRGLDFACDIYIWAPLAGTCGVLLLSLVITLYCKRGRKKLL YIFKQPFMRPVQTTQEEDGCSCRFPEEEEGGCELRVKFSRSAD APAYQQGQNQLYNELNLGRREEYDVLDKRRGRDPEMGGKPR RKNPQEGLYNELQKDKMAEAYSEIGMKGERRRGKGHDGLYQ GLSTATKDTYDALHMQALPPR |
| 646 | CD8α signal sequence, 3F2 scFv, CD8α hinge and transmembrane regions, 41BB cytoplasmic signaling domain, CD3ζ cytoplasmic signaling domain | MALPVTALLLPLALLLHAARPQVQLQESGPGLVKPSGTLSLTC AVSGGSISSnNWWSWVRQPPGKGLEWIGDIHHSGSTNYKPSL KSRVTISVDKSKNQFSLNLISVTAADTAVYYCAREAGGYFDY WGQGILVTVSSGGGGSGGGGSGGGGSGGGGSDIQMTQSPSTL SASVGDRVTITCRASQSISSWLAWYQQKPGKAPKLLISKASSL ESGVPSRFSGSGSGPEFTLTISSLQPADFATYYCQQYNSYSTFG QGTKLEIKTTTPAPRPPTPAPTIASQPLSLRPEACRPAAGGAVH TRGLDFACDIYIWAPLAGTCGVLLLSLVITLYCKRGRKKLLYIF KQPFMRPVQTTQEEDGCSCRFPEEEEGGCELRVKFSRSADAPA YQQGQNQLYNELNLGRREEYDVLDKRRGRDPEMGGKPRRK NPQEGLYNELQKDKMAEAYSEIGMKGERRRGKGHDGLYQGL STATKDTYDALHMQALPPR |
| 647 | CD8α signal sequence, 4F9 scFv, CD8α hinge and transmembrane regions, 41BB cytoplasmic signaling domain, CD3ζ cytoplasmic signaling domain | MALPVTALLLPLALLLHAARPQVQLQQWGAGLLKPSETLSLT CAVYGGSFSGYYWTWIRQPPGKGLEWIGEITHSGSTNYNPSL KSRVSISVDTSKNQFSLKLSSVTAADTAVYYCARGEYGsgSRF DYWGQGTLVTVSSGGGGSGGGGSGGGGSGGGGSAIQMTQSP SSLSASVGDRVAITCRASQGIRDDLGWYQQKPGKAPKLLIYA ASSLQSGVPSRFSGSGSDTDFTLTISSLQPEDFATYYCLQDYDY PLTFGGGGTKVEIKTTTPAPRPPTPAPTIASQPLSLRPEACRPAAG GAVHTRGLDFACDIYIWAPLAGTCGVLLLSLVITLYCKRGRK KLLYIFKQPFMRPVQTTQEEDGCSCRFPEEEEGGCELRVKFSR SADAPAYQQGQNQLYNELNLGRREEYDVLDKRRGRDPEMGG KPRRKNPQEGLYNELQKDKMAEAYSEIGMKGERRRGKGHDG LYQGLSTATKDTYDALHMQALPPR |
| 648 | CD8α signal sequence, 4G9 scFv, CD8α hinge and transmembrane regions, 41BB cytoplasmic signaling domain, CD3ζ cytoplasmic signaling domain | MALPVTALLLPLALLLHAARPQVQLQQWGAGLLKPSETLSLT CAVYGGSFSGYYWSWIRQPPGKGLEWIGEITHSGSTNYNPSLK SRVSISVDTSKNQFSLKLSSVTAADTAVYYCARGEYGsgSRFD YWGQGTLVTVSSGGGGSGGGGSGGGGSGGGGSAIQMTQSPS SLSASVGDRVALTCRASQGIRDDLGWYQQKPGKAPKLLIYAA SSLQSGVPSRFSGSGSDTDFTLTISSLQPEDFATYYCLQDYDYP LTFGGGGTKVEIKTTTPAPRPPTPAPTIASQPLSLRPEACRPAAG GAVHTRGLDFACDIYIWAPLAGTCGVLLLSLVITLYCKRGRK KLLYIFKQPFMRPVQTTQEEDGCSCRFPEEEEGGCELRVKFSR SADAPAYQQGQNQLYNELNLGRREEYDVLDKRRGRDPEMGG KPRRKNPQEGLYNELQKDKMAEAYSEIGMKGERRRGKGHDG LYQGLSTATKDTYDALHMQALPPR |
| 649 | CD8α signal sequence, 11H7 scFv, CD8α hinge and transmembrane regions, 41BB | MALPVTALLLPLALLLHAARPQVQLQQWGAGLLKPSETLSLT CAVYGGSFSAYYWNWIRQPPGKGLEWIGEINHSGSTNYNPSL KSRVTISVDTSKNQFSLNLTSLTAADTAVYYCARGLDSsgwYP FDYWGQGTLVTVSSGGGGSGGGGSGGGGSGGGGSDIQMTQS PSSVSASVGDRVTITCRASQGISSWLAWYQQKPGKAPKLLIYA |

TABLE 7-continued

CAR amino acid sequences

| SEQ ID NO: | Name/Component | Sequence |
|---|---|---|
| | cytoplasmic signaling domain, CD3ζ cytoplasmic signaling domain | ASSLQSGVPSRFSGSGSGTDFTLTISSLQPEDFATYYCQQADSF PFTFGPGTKVDIKTTTPAPRPPTPAPTIASQPLSLRPEACRPAAG GAVHTRGLDFACDIYIWAPLAGTCGVLLLSLVITLYCKRGRK KLLYIFKQPFMRPVQTTQEEDGCSCRFPEEEEGGCELRVKFSR SADAPAYQQGQNQLYNELNLGRREEYDVLDKRRGRDPEMGG KPRRKNPQEGLYNELQKDKMAEAYSEIGMKGERRRGKGHDG LYQGLSTATKDTYDALHMQALPPR |
| 650 | CD8α signal sequence, 16H7 scFv, CD8α hinge and transmembrane regions, 41BB cytoplasmic signaling domain, CD3ζ cytoplasmic signaling domain | MALPVTALLLPLALLLHAARPQVQLQQWGAGLLKPSETLSLT CAVFGGSFSGDYWSWIRQPPGKGLEWIGEINHSGITSFNPSLKS RVTISVDTSKNQFSLKLSSVTAADTAVYYCARGELGIPDNWG QGTLVTVSSGGGGSGGGGSGGGGSGGGGSDIQMTQSPSTLSA SVGDRVTITCRASQSISRWLAWYQQKPGKAPKLLIYKASSLES GVPSRFSGSGSGTEFTLTISSLQPDDFATYYCQQYNSYSTFGQG TKVEIKTTTPAPRPPTPAPTIASQPLSLRPEACRPAAGGAVHTR GLDFACDIYIWAPLAGTCGVLLLSLVITLYCKRGRKKLLYIFK QPFMRPVQTTQEEDGCSCRFPEEEEGGCELRVKFSRSADAPAY QQGQNQLYNELNLGRREEYDVLDKRRGRDPEMGGKPRRKNP QEGLYNELQKDKMAEAYSEIGMKGERRRGKGHDGLYQGLST ATKDTYDALHMQALPPR |
| 651 | CD8α signal sequence, 17A2 scFv, CD8α hinge and transmembrane regions, 41BB cytoplasmic signaling domain, CD3ζ cytoplasmic signaling domain | MALPVTALLLPLALLLHAARPQVQLQESGPGLVKPSGTLSLTC VVFGDSISSsNWWSWVRQPPGKGLEWIGEVFHSGSTNYNPSL KSRVTISVDKSKNQFSLKLSSVTAADTAVYYCARAAVAGALD YWGQGTLVTVSSGGGGSGGGGSGGGGSGGGGSDIVMTQSPD SLAVSLGERATINCKSSQSVLYSSNNKNYLAWYQQKPGQPPN LLVYWASTRESGVPDRFSGAGSGTDFTLTISSLQAEDVAVYYC QQYYGTSWTFGQGTKVEIKTTTPAPRPPTPAPTIASQPLSLRPE ACRPAAGGAVHTRGLDFACDIYIWAPLAGTCGVLLLSLVITLY CKRGRKKLLYIFKQPFMRPVQTTQEEDGCSCRFPEEEEGGCEL RVKFSRSADAPAYQQGQNQLYNELNLGRREEYDVLDKRRGR DPEMGGKPRRKNPQEGLYNELQKDKMAEAYSEIGMKGERRR GKGHDGLYQGLSTATKDTYDALHMQALPPR |
| 652 | CD8α signal sequence, 6H1 scFv, CD8α hinge and transmembrane regions, 41BB cytoplasmic signaling domain, CD3ζ cytoplasmic signaling domain | MALPVTALLLPLALLLHAARPQITLRESGPTLVKPTQTLTLTCT FSGFSLSTSgLGVGWIRQPPGEALEWLALIYWNDDKRYSPSLK SRLSITKDTSKNQVVLIMTNMDPVDTATYYCVHRRIAaPGSVY WGQGTLVTVSSGGGGSGGGGSGGGGSGGGGSDIQMTQSPSS VSASVGDRVTITCRASQGISSWLAWYQQKPGKAPKLLISAASS LQSGVPSRFSGSGSGTDFTLTISSLQPEDFATYYCHQANSFPFT FGQGTKLEIKTTTPAPRPPTPAPTIASQPLSLRPEACRPAAGGA VHTRGLDFACDIYIWAPLAGTCGVLLLSLVITLYCKRGRKKLL YIFKQPFMRPVQTTQEEDGCSCRFPEEEEGGCELRVKFSRSAD APAYQQGQNQLYNELNLGRREEYDVLDKRRGRDPEMGGKPR RKNPQEGLYNELQKDKMAEAYSEIGMKGERRRGKGHDGLYQ GLSTATKDTYDALHMQALPPR |
| 653 | CD8α signal sequence, 6H5 scFv, CD8α hinge and transmembrane regions, 41BB cytoplasmic signaling domain, CD3ζ cytoplasmic signaling domain | MALPVTALLLPLALLLHAARPQVQLVQSGAEVKKPGASVKVS CKVSGYTLTELSMHWVRQAPGKGPEGMGGFDpEDGKTIYAQ KFQGRVTMTEDTSADTAYMELNSLRSEDTAVYYCATLLRG1D AFDVWGQGTMVTVSSGGGGSGGGGSGGGGSGGGGSDIQMT QSPSSLSASVGDRVTITCRASQGIRNDLGWYQQKPGKAPKRLI YAASSLQSGVPSRFSGSGSGTEFTLTISTLQPEDFATYYCLQHN SYPRTFGQGTKVEIKTTTPAPRPPTPAPTIASQPLSLRPEACRPA AGGAVHTRGLDFACDIYIWAPLAGTCGVLLLSLVITLYCKRG RKKLLYIFKQPFMRPVQTTQEEDGCSCRFPEEEEGGCELRVKF SRSADAPAYQQGQNQLYNELNLGRREEYDVLDKRRGRDPEM GGKPRRKNPQEGLYNELQKDKMAEAYSEIGMKGERRRGKGH DGLYQGLSTATKDTYDALHMQALPPR |
| 654 | CD8α signal sequence, 10D1 scFv, CD8α hinge and transmembrane regions, 41BB cytoplasmic signaling domain, CD3ζ cytoplasmic signaling domain | MALPVTALLLPLALLLHAARPQVQLQQWGAGLLKPSETLSLT CAVYGGSFSGYYWRWIRQPPGKGLEWIGEISHSGSTNYNPSL KSRVTISVDTSKNQFSLKLSSVTAADTAVYYCAVRGYSygyPLF DYWGQGTLVTVSSGGGGSGGGGSGGGGSGGGGSDIQMTQSP SSLSASVGDRVTITCRASQGIRNDLGWYQQKLGKAPKRLIYA ASSLQSGVPSRFSGSGSGTEFTLTISSLQPEDFATYYCLQYNSY PRTFGQGTKVEIKTTTPAPRPPTPAPTIASQPLSLRPEACRPAAG GAVHTRGLDFACDIYIWAPLAGTCGVLLLSLVITLYCKRGRK KLLYIFKQPFMRPVQTTQEEDGCSCRFPEEEEGGCELRVKFSR SADAPAYQQGQNQLYNELNLGRREEYDVLDKRRGRDPEMGG KPRRKNPQEGLYNELQKDKMAEAYSEIGMKGERRRGKGHDG LYQGLSTATKDTYDALHMQALPPR |

TABLE 7-continued

CAR amino acid sequences

| SEQ ID NO: | Name/Component | Sequence |
|---|---|---|
| 655 | CD8α signal sequence, 11F6 scFv, CD8α hinge and transmembrane regions, 41BB cytoplasmic signaling domain, CD3ζ cytoplasmic signaling domain | MALPVTALLLPLALLLHAARPQVQLQESGPGLVKPSGTLSLTC AVSGDSISSNWWTWVRQPPGKGLEWIGDIHHSGSTNYNPSLK SRVTMSVDKSENQFSLKLSSVTAADTAVFYCARDGGGTLDY WGQGTLVTVSSGGGGSGGGGSGGGGSGGGGSDIQMTQSPST LSASVGDRVTITCRASQSISSWLAWYQQKPGKAPKLLIYKAST LESGVPSRFSGSGSGTEFTLTISSLQPDDFATYYCQQYNGYSTF GQGTKVEIKTTTPAPRPPTPAPTIASQPLSRPEACRPAAGGAV HTRGLDFACDIYIWAPLAGTCGVLLLSLVITLYCKRGRKKLLY IFKQPFMRPVQTTQEEDGCSCRFPEEEEGGCELRVKFSRSADA PAYQQGQNQLYNELNLGRREEYDVLDKRRGRDPEMGGKPRR KNPQEGLYNELQKDKMAEAYSEIGMKGERRRGKGHDGLYQ GLSTATKDTYDALHMQALPPR |
| 656 | CD8α signal sequence, 6F8 scFv, CD8α hinge and transmembrane regions, 41BB cytoplasmic signaling domain, CD3ζ cytoplasmic signaling domain | MALPVTALLLPLALLLHAARPQVQLVQSGAEVKKPGSSVKVS CKASGGTFTNYCISWVRQAPGQGLEWMGGIIpIFGTTNYAQTF QGRVTITADKSTSTAYMELSSLRSEDTAVYYCARDNGDryyYD MDVWGQGTTVTVSSGGGGSGGGGSGGGGSGGGGSQSVLTQP PSVSAAPGQKVTISCSGSSSNIGNNYVSWYQQLPGTAPKLLIY DNNKRPSGIPDRFSGSKSGTSATLGITGLQTGDEADYYCGTWD SSLSAVVFGGGTKLTVLTTTPAPRPPTPAPTIASQPLSRPEACR PAAGGAVHTRGLDFACDIYIWAPLAGTCGVLLLSLVITLYCKR GRKKLLYIFKQPFMRPVQTTQEEDGCSCRFPEEEEGGCELRVK FSRSADAPAYQQGQNQLYNELNLGRREEYDVLDKRRGRDPE MGGKPRRKNPQEGLYNELQKDKMAEAYSEIGMKGERRRGK GHDGLYQGLSTATKDTYDALHMQALPPR |
| 657 | CD8α signal sequence, 3G6-L1 scFv, CD8α hinge and transmembrane regions, 41BB cytoplasmic signaling domain, CD3ζ cytoplasmic signaling domain | MALPVTALLLPLALLLHAARPQVPLVQSGAEVKKPGSSVKVS CKASGGTFSTYSISWVRQAPGQGLEWMGGIIpIFGTTNYAQKF QGRVTITADKSTSTAYMELSSLRSEDTAVYYCARDGEGsyyyy YGMDVWGQGTTVTVSSGGGGSGGGGSGGGGSGGGGSQSVL TQPPSVSAAPGQKVTISCSGSSSNIGNNYVSWYQQLPGTAPKL LIYDNNKRPSGIPDRFFGSKFGTSATLGITGLQTGDEADYYCGT WDSSLSAVVFGGGTKLTVLTTTPAPRPPTPAPTIASQPLSRPE ACRPAAGGAVHTRGLDFACDIYIWAPLAGTCGVLLLSLVITLY CKRGRKKLLYIFKQPFMRPVQTTQEEDGCSCRFPEEEEGGCEL RVKFSRSADAPAYQQGQNQLYNELNLGRREEYDVLDKRRGR DPEMGGKPRRKNPQEGLYNELQKDKMAEAYSEIGMKGERRR GKGHDGLYQGLSTATKDTYDALHMQALPPR |
| 658 | CD8α signal sequence, 4C6 scFv, CD8α hinge and transmembrane regions, 41BB cytoplasmic signaling domain, CD3ζ cytoplasmic signaling domain | MALPVTALLLPLALLLHAARPQVQLQESGPGLVKPSETLSLTC TVSGDSISSYYWSWIRQPPGKGLEWIGYMYYSGITNYNPSLKS RVNISLDTSKNQFSLKLGSVTAADTAVYYCARLSVAgFYFDY WGQGTLVTVSSGGGGSGGGGSGGGGSGGGGSEIVLTQSPGTL SLSPGERATLSCRASQSVTRSYLAWYQQKPGQAPRLLIYGASS RATDIPDRFSGSGSGTDFTLTINRLEPEDFAVYYCQQYGTSPLT FGGGTKVEIKTTTPAPRPPTPAPTIASQPLSRPEACRPAAGGA VHTRGLDFACDIYIWAPLAGTCGVLLLSLVITLYCKRGRKKLL YIFKQPFMRPVQTTQEEDGCSCRFPEEEEGGCELRVKFSRSAD APAYQQGQNQLYNELNLGRREEYDVLDKRRGRDPEMGGKPR RKNPQEGLYNELQKDKMAEAYSEIGMKGERRRGKGHDGLYQ GLSTATKDTYDALHMQALPPR |
| 659 | CD8α signal sequence, 4E6 scFv, CD8α hinge and transmembrane regions, 41BB cytoplasmic signaling domain, CD3ζ cytoplasmic signaling domain | MALPVTALLLPLALLLHAARPQVQLQESGPGLVKPSETLSLTC TVSSDSISSYYWSWIRQPPGKGLEWISYIYYSGISNYNPSLKSR VSISVDTSKNQFSLRLSSVTAADTAVYYCARISVAgFFFDNWG QGTLVTVSSGGGGSGGGGSGGGGSGGGGSEIMLTQSPDTLSL SPGERATLSCRASQSVSSSYLAWYQQKPGQAPRLLIYGASSRA AGVPDRFSGSGSGTDFTLTISRLAPEDFVVYYCQQYGISPLTFG GGTKVEIKTTTPAPRPPTPAPTIASQPLSRPEACRPAAGGAVH TRGLDFACDIYIWAPLAGTCGVLLLSLVITLYCKRGRKKLLYIF KQPFMRPVQTTQEEDGCSCRFPEEEEGGCELRVKFSRSADAPA YQQGQNQLYNELNLGRREEYDVLDKRRGRDPEMGGKPRRK NPQEGLYNELQKDKMAEAYSEIGMKGERRRGKGHDGLYQGL STATKDTYDALHMQALPPR |
| 660 | CD8α signal sequence, 4H8 scFv, CD8α hinge and transmembrane regions, 41BB | MALPVTALLLPLALLLHAARPQVQLQQSGPGLVKPSQTLSLTC AISGDSVSSnsATWNWIRQSPSRGLEWLGRTYYRSKwyDDYAV SVKSRITINPDTSKNHLSLHLNSVTPEDTAVYYCAGGGLVgapD GFDVWGQGTMVTVSSGGGGSGGGGSGGGGSGGGGSQSVLT QPPSASGTPGQRVTISCSGSSSNIGSDPVNWYQQLPGTAPKLLI |

TABLE 7-continued

CAR amino acid sequences

| SEQ ID NO: | Name/ Component | Sequence |
|---|---|---|
|  | cytoplasmic signaling domain, CD3ζ cytoplasmic signaling domain | YSNNQRPSGVPDRFSGSKSGTSASLAISGLQSEDEADYYCSAW DDSLNGYVFGTGTKVTVLTTTPAPRPPTPAPTIASQPLSLRPEA CRPAAGGAVHTRGLDFACDIYIWAPLAGTCGVLLLSLVITLYC KRGRKKLLYIFKQPFMRPVQTTQEEDGCSCRFPEEEEGGCELR VKFSRSADAPAYQQGQNQLYNELNLGRREEYDVLDKRRGRD PEMGGKPRRKNPQEGLYNELQKDKMAEAYSEIGMKGERRRG KGHDGLYQGLSTATKDTYDALHMQALPPR |
| 661 | CD8α signal sequence, 9H12-K scFv, CD8α hinge and transmembrane regions, 41BB cytoplasmic signaling domain, CD3ζ cytoplasmic signaling domain | MALPVTALLLPLALLLHAARPQVQLVQSGAEVKKPGASVKVS CKASGYTFTGYSIHWVRQAPGQGLEWMGWINpNSGGTFYAQ KFQGRVTMTRDTSISTVYMELSRLRSDDTAVYYCARDGWGdy yyYGLDVWGQGTTVTVSLGGGGSGGGGSGGGGSGGGGSDIQ MTQSPSSVSASVGDRVTITCRASQDISSWLAWYQQKPGKAPK LLIYTASSLQGGVPSRFSGSGSGTDFTLTISSLQPEDLATYSCQQ ANVFPYTFGQGTKLEIKTTTPAPRPPTPAPTIASQPLSLRPEACR PAAGGAVHTRGLDFACDIYIWAPLAGTCGVLLLSLVITLYCKR GRKKLLYIFKQPFMRPVQTTQEEDGCSCRFPEEEEGGCELRVK FSRSADAPAYQQGQNQLYNELNLGRREEYDVLDKRRGRDPE MGGKPRRKNPQEGLYNELQKDKMAEAYSEIGMKGERRRGK GHDGLYQGLSTATKDTYDALHMQALPPR |
| 662 | CD8α signal sequence, 10G1-K scFv, CD8α hinge and transmembrane regions, 41BB cytoplasmic signaling domain, CD3ζ cytoplasmic signaling domain | MALPVTALLLPLALLLHAARPEVQLLESGGGLVQPGGSLRLSC AASGFTFSSYAMNWVRQAPGKGLEWVSTISgSGGSTYYADSV KGRFTISRDNSKNTLYLQMNSLRAEDTAVFYCAIDPEYydilTG GDYWGQGTLVTVSSGGGGSGGGGSGGGGSGGGGSDIQMTQS PSAMSASVGDRVTITCRASQGISNYLAWFQQKPGKVPKRLIYA ASSLQSGVPSRFSGSGSGTEFTLTISSLQPEDFATYFCLQHDSFP LTFGGGTKVEIKTTTPAPRPPTPAPTIASQPLSLRPEACRPAAG GAVHTRGLDFACDIYIWAPLAGTCGVLLLSLVITLYCKRGRK KLLYIFKQPFMRPVQTTQEEDGCSCRFPEEEEGGCELRVKFSR SADAPAYQQGQNQLYNELNLGRREEYDVLDKRRGRDPEMGG KPRRKNPQEGLYNELQKDKMAEAYSEIGMKGERRRGKGHDG LYQGLSTATKDTYDALHMQALPPR |
| 663 | CD8α signal sequence, 11A3 scFv, CD8α hinge and transmembrane regions, 41BB cytoplasmic signaling domain, CD3ζ cytoplasmic signaling domain | MALPVTALLLPLALLLHAARPQVQLQESGPGLVKPSETLSLTC TVSSDSISNYYWSWIRQPPGKGLEWISYIYYSGITNYNPSLKSR VTISVDTSKNQFSLKLSSVTAADTAVYYCARITVTgFYFDYWG QGTLVTVSSGGGGSGGGGSGGGGSGGGGSEIVLTQSPGTLSLS PGERATLSCRASQSISRSYLAWYQQKPGQAPRHLIYGASSRAT GIPDRFSGSGSGTDFILTISRLEPEDFAVYYCQQYDTSPLTFGG GTKVEIKTTTPAPRPPTPAPTIASQPLSLRPEACRPAAGGAVHT RGLDFACDIYIWAPLAGTCGVLLLSLVITLYCKRGRKKLLYIF KQPFMRPVQTTQEEDGCSCRFPEEEEGGCELRVKFSRSADAPA YQQGQNQLYNELNLGRREEYDVLDKRRGRDPEMGGKPRRK NPQEGLYNELQKDKMAEAYSEIGMKGERRRGKGHDGLYQGL STATKDTYDALHMQALPPR |
| 664 | CD8α signal sequence, 3B11 scFv, CD8α hinge and transmembrane regions, 41BB cytoplasmic signaling domain, CD3ζ cytoplasmic signaling domain | MALPVTALLLPLALLLHAARPQVQLQQSGPGLVKPSQTLSLTC AISGDSVSSnsVVWNWIRQSPSRGLEWLGRTYYRSKwyDDYA VSVKSRITINPDTSKNQFSLQLNSVTPEDTAVYHCARGGIVgap DAFDIWGQGTMVTVSSGGGGSGGGGSGGGGSGGGGSQSVLT QPPSASGTPGQRVTISCSGSSSNIGSDPVSWYQQFPGTAPKLLI YTNNQRPSGVPDRFSGSKSGTSASLAISGLQSEDEADYYCAA WDDSLNGHVFGTGTKVTVLTTTPAPRPPTPAPTIASQPLSLRPE ACRPAAGGAVHTRGLDFACDIYIWAPLAGTCGVLLLSLVITLY CKRGRKKLLYIFKQPFMRPVQTTQEEDGCSCRFPEEEEGGCEL RVKFSRSADAPAYQQGQNQLYNELNLGRREEYDVLDKRRGR DPEMGGKPRRKNPQEGLYNELQKDKMAEAYSEIGMKGERRR GKGHDGLYQGLSTATKDTYDALHMQALPPR |
| 665 | CD8α signal sequence, 5G2 scFv, CD8α hinge and transmembrane regions, 41BB cytoplasmic signaling domain, CD3ζ cytoplasmic signaling domain | MALPVTALLLPLALLLHAARPQVQLQQSGPGLVKPSQTLSLTC AISGDSVSSnsAVWNWIRQSPSRGLEWLGWTYYRSKYYndYA VSLKSRITINPDTSKNQFSLQLNSLTPEDTAVYYCTRGGIVgapD GFDIWGQGTMVTVSSGGGGSGGGGSGGGGSGGGGSQSALTQ PPSASGTPGQRVTISCSGSNSNIGSNPINWYQQLPGTAPKLLIYS NNQRPSGVPDRFSGSKSGTSASLAISGLQSEDEADYYCAAWD DSLNGHVFGTGTKVTVLTTTPAPRPPTPAPTIASQPLSLRPEAC RPAAGGAVHTRGLDFACDIYIWAPLAGTCGVLLLSLVITLYCK RGRKKLLYIFKQPFMRPVQTTQEEDGCSCRFPEEEEGGCELRV KFSRSADAPAYQQGQNQLYNELNLGRREEYDVLDKRRGRDP EMGGKPRRKNPQEGLYNELQKDKMAEAYSEIGMKGERRRGK GHDGLYQGLSTATKDTYDALHMQALPPR |

TABLE 7-continued

CAR amino acid sequences

| SEQ ID NO: | Name/Component | Sequence |
|---|---|---|
| 666 | CD8α signal sequence, 11E4 scFv, CD8α hinge and transmembrane regions, 41BB cytoplasmic signaling domain, CD3ζ cytoplasmic signaling domain | MALPVTALLLPLALLLHAARPQVQLQESGPGLVKPSETLSLTC TVSGGSISSYYWSWIRQSPGKGLEWIGYVYYSDITNYNPSLKS RVTISVDTSKNQFSLNLNSVTAADTAFYFCARIGVAgFYFDYW GQGTLVTVSSGGGGSGGGGSGGGGSGGGGSEIVLTQSPDTLS LSPGERATLSCRASQSVSRRYLAWYQQKPGQAPRLLIYGASSR ATGIPDRFSGSGSGTDFTLTISRLEPEDFEVYYCQQYGTSPITFG QGTRLEIKTTTPAPRPPTPAPTIASQPLSLRPEACRPAAGGAVH TRGLDFACDIYIWAPLAGTCGVLLLSLVITLYCKRGRKKLLYIF KQPFMRPVQTTQEEDGCSCRFPEEEEGGCELRVKFSRSADAPA YQQGQNQLYNELNLGRREEYDVLDKRRGRDPEMGGKPRRK NPQEGLYNELQKDKMAEAYSEIGMKGERRRGKGHDGLYQGL STATKDTYDALHMQALPPR |
| 667 | CD8α signal sequence, 2404.8E11 scFv, CD8α hinge and transmembrane regions, 41BB cytoplasmic signaling domain, CD3ζ cytoplasmic signaling domain | MALPVTALLLPLALLLHAARPQIQLQQSGPGLVKPSQTLSLTC AISGDSVSSnsAVWNWIRQSPSRGLEWLGRTYYRSKwyNDYA VSVKSRITIKPDTAKNQFSLQLNSVTPEDTAVYYFTRGGIVgap DAFDIWGQGTMVTVSSGGGGSGGGGSGGGGSGGGGSQSVLT QPPSASGTPGQRVTISCSGSSSNIGSDPINWYQQVPGTAPKLLI YSNNQRPSGVPDRFSGSKSGTSASLAISGLQSEDEADYYCAA WDDSLNGYVFGTGTKVTVLTTTPAPRPPTPAPTIASQPLSLRPE ACRPAAGGAVHTRGLDFACDIYIWAPLAGTCGVLLLSLVITLY CKRGRKKLLYIFKQPFMRPVQTTQEEDGCSCRFPEEEEGGCEL RVKFSRSADAPAYQQGQNQLYNELNLGRREEYDVLDKRRGR DPEMGGKPRRKNPQEGLYNELQKDKMAEAYSEIGMKGERRR GKGHDGLYQGLSTATKDTYDALHMQALPPR |
| 668 | CD8α signal sequence, 10A2 scFv, CD8α hinge and transmembrane regions, 41BB cytoplasmic signaling domain, CD3ζ cytoplasmic signaling domain | MALPVTALLLPLALLLHAARPQVQLQQSGPGLVKPSETLSLTC AISGDSVSSnsATWNWIRQSPSRGLEWLGRTYYRSEwyNDYAV SVKSRITINPDTSKNHLSLHLNSVTPEDTAVYYCAGGGIVgapD GFDVWGQGTMVTVSSGGGGSGGGGSGGGGSGGGGSQSVLT QPPSASGTPGQRVTISCSGSSSNIGSDPVIWYQQLPRTAPKLLIY SNNQRPSGVPDRFSGSKSGTSASLAISGLQSEDEADYYCAAW DDSLNGYVFGTGTKVTVLTTTPAPRPPTPAPTIASQPLSLRPEA CRPAAGGAVHTRGLDFACDIYIWAPLAGTCGVLLLSLVITLYC KRGRKKLLYIFKQPFMRPVQTTQEEDGCSCRFPEEEEGGCELR VKFSRSADAPAYQQGQNQLYNELNLGRREEYDVLDKRRGRD PEMGGKPRRKNPQEGLYNELQKDKMAEAYSEIGMKGERRRG KGHDGLYQGLSTATKDTYDALHMQALPPR |
| 669 | CD8α signal sequence, 11A8 scFv, CD8α hinge and transmembrane regions, 41BB cytoplasmic signaling domain, CD3ζ cytoplasmic signaling domain | MALPVTALLLPLALLLHAARPQVQLQQSGPGLVKPSQTLSLTC AISGDSVSSnsATWNWIRQSPSTGLEWLARTYYRSKwyNDYEV SVKSQITINPDTSKNQFSLQLNSVTPEDTAVYYCARGGIVgapD AFDIWGQGTMVTVSSGGGGSGGGGSGGGGSGGGGSQSVLTQ PPSASGTPGQGVTISCSGSSSNIGSNPVNWYQQLPGTAPKLLIY SNNQRPSGVPDRFSDSKSGTSASLAISGLQSEDEADYYCSAWD DWLNGYVFGTGTKVTVLTTTPAPRPPTPAPTIASQPLSLRPEA CRPAAGGAVHTRGLDFACDIYIWAPLAGTCGVLLLSLVITLYC KRGRKKLLYIFKQPFMRPVQTTQEEDGCSCRFPEEEEGGCELR VKFSRSADAPAYQQGQNQLYNELNLGRREEYDVLDKRRGRD PEMGGKPRRKNPQEGLYNELQKDKMAEAYSEIGMKGERRRG KGHDGLYQGLSTATKDTYDALHMQALPPR |
| 670 | CD8α signal sequence, 4H5 scFv, CD8α hinge and transmembrane regions, 41BB cytoplasmic signaling domain, CD3ζ cytoplasmic signaling domain | MALPVTALLLPLALLLHAARPQVQLQESGPGLVKPSETLSLTC TVSGDSINNYFWSWIRQPPGKGLEWIGYFYHRGGNNYNPSLK SRVTISIDTSKNQFSLNLNSVTSADTAVYYCARLALAgFFFDY WGQGTLVTVSSGGGGSGGGGSGGGGSGGGGSDIQMTQSPST LSASVGDRVTITCRASQSISSWLAWYQQKPGKAPKLLIYKASS LESGVPSRFSGSGSGTEFTLTISSLQPDDFATYYCQQYNSYSRT FGQGTKVEIKTTTPAPRPPTPAPTIASQPLSLRPEACRPAAGGA VHTRGLDFACDIYIWAPLAGTCGVLLLSLVITLYCKRGRKKLL YIFKQPFMRPVQTTQEEDGCSCRFPEEEEGGCELRVKFSRSAD APAYQQGQNQLYNELNLGRREEYDVLDKRRGRDPEMGGKPR RKNPQEGLYNELQKDKMAEAYSEIGMKGERRRGKGHDGLYQ GLSTATKDTYDALHMQALPPR |
| 671 | CD8α signal sequence, 3G6-L2 scFv, CD8α hinge and transmembrane regions, 41BB | MALPVTALLLPLALLLHAARPQVPLVQSGAEVKKPGSSVKVS CKASGGTFSTYSISWVRQAPGQGLEWMGGIIpIFGTTNYAQKF QGRVTITADKSTSTAYMELSSLRSEDTAVYYCARDGEGsyyyy YGMDVWGQGTTVTVSSGGGGSGGGGSGGGGSGGGGSQSVL TQPPSASGTPGQRVTISCSGSSSNIGSNYVYWYQQLPGTAPKL |

TABLE 7-continued

CAR amino acid sequences

| SEQ ID NO: | Name/Component | Sequence |
|---|---|---|
| | cytoplasmic signaling domain, CD3ζ cytoplasmic signaling domain | LIYSNNQRPSGVPDRFSGSKSGTSASLAISGLRSEDEADYYCAA WDDSLSGWVFGGGTKLTVLTTTPAPRPPTPAPTIASQPLSLRPE ACRPAAGGAVHTRGLDFACDIYIWAPLAGTCGVLLLSLVITLY CKRGRKKLLYIFKQPFMRPVQTTQEEDGCSCRFPEEEEGGCEL RVKFSRSADAPAYQQGQNQLYNELNLGRREEYDVLDKRRGR DPEMGGKPRRKNPQEGLYNELQKDKMAEAYSEIGMKGERRR GKGHDGLYQGLSTATKDTYDALHMQALPPR |
| 672 | CD8α signal sequence, 3B9 scFv, CD8α hinge and transmembrane regions, 41BB cytoplasmic signaling domain, CD3ζ cytoplasmic signaling domain | MALPVTALLLPLALLLHAARPEVQLVESGGGLVQPGGSLRLS CAASGFTFSSYSMNWVRQAPGKGLEWVSYISsSSSTIYYADSV KGRFTISRDNAKNSLYLQMNSLRDEDTAVYYCARDKERryyyY GMDVWGQGTTVTVSSGGGGSGGGGSGGGGSGGGGSEIVLTQ SPDTLSLSPGERATLSCRASQSVSRRYLAWYQQKPGQAPRLLI YGASSRATGIPDRFSGSGSGTDFTLTISRLEPEDFAVYYCQQFG TSPITFGQGTRLEIKTTTPAPRPPTPAPTIASQPLSLRPEACR-PAA GGAVHTRGLDFACDIYIWAPLAGTCGVLLLSLVITLYCKRGR KKLLYIFKQPFMRPVQTTQEEDGCSCRFPEEEEGGCELRVKFS RSADAPAYQQGQNQLYNELNLGRREEYDVLDKRRGRDPEMG GKPRRKNPQEGLYNELQKDKMAEAYSEIGMKGERRRGKGHD GLYQGLSTATKDTYDALHMQALPPR |
| 673 | CD8α signal sequence, 3F9-L scFv, CD8α hinge and transmembrane regions, 41BB cytoplasmic signaling domain, CD3ζ cytoplasmic signaling domain | MALPVTALLLPLALLLHAARPQVQLQQSGPGLVKPSQTLSLA CAISGDSVSSnsAIWNWIRQSPSRGLEWLGGTYYRSMwyNDYA VSVKSRITINPDTSKNQLSLQLNSVTPEDTAVYYCSRGGIVgvp DAFDIWGQGTMVTVSSGGGGSGGGGSGGGGSGGGGSQSVLT QPPSASGTPGQRVTISCSGSSSNIGSNTANWYQQLPGTAPRLLI YRNNQRPSGVPDRFSGSKSGTSASLAISGLQSEDEADYYCAA WDDSLNGYVFGTGTKVTVLTTTPAPRPPTPAPTIASQPLSLRPE ACRPAAGGAVHTRGLDFACDIYIWAPLAGTCGVLLLSLVITLY CKRGRKKLLYIFKQPFMRPVQTTQEEDGCSCRFPEEEEGGCEL RVKFSRSADAPAYQQGQNQLYNELNLGRREEYDVLDKRRGR DPEMGGKPRRKNPQEGLYNELQKDKMAEAYSEIGMKGERRR GKGHDGLYQGLSTATKDTYDALHMQALPPR |
| 674 | CD8α signal sequence, 3E10 scFv, CD8α hinge and transmembrane regions, 41BB cytoplasmic signaling domain, CD3ζ cytoplasmic signaling domain | MALPVTALLLPLALLLHAARPQVQLQESGPGLVKPSETLSLTC NVSDGSISSYYWTWIRQPPGKGLDWIGYIFYSGTTNYNPSLKS RVTISLDTSKNQFSLKLTSMTAADTAVYYCARISEKsFYFDYW GQGTLVTVSSGGGGSGGGGSGGGGSGGGGSQSVLTQPPSASG TPGQRVTISCSGSSSNIGSNYVYWYQQLPGTAPKLLIYSNNQR PSGVPDRFSGSKSGTSASLAISGLRSEDEADYYCAPWDDSLSG RVFGGGTKLTVLTTTPAPRPPTPAPTIASQPLSLRPEACRPAAG GAVHTRGLDFACDIYIWAPLAGTCGVLLLSLVITLYCKRGRK KLLYIFKQPFMRPVQTTQEEDGCSCRFPEEEEGGCELRVKFSR SADAPAYQQGQNQLYNELNLGRREEYDVLDKRRGRDPEMGG KPRRKNPQEGLYNELQKDKMAEAYSEIGMKGERRRGKGHDG LYQGLSTATKDTYDALHMQALPPR |
| 675 | CD8α signal sequence, 3C3 scFv, CD8α hinge and transmembrane regions, 41BB cytoplasmic signaling domain, CD3ζ cytoplasmic signaling domain | MALPVTALLLPLALLLHAARPQVQLVQSGAEVKRPGASVKVS CKASGYTFTSYYIHWVRQAPGQGLEWMGVIVpSGGGSISYAQK FQGRVTMTRDTSTNIVYMELSSLRSEDTAVYYCARDRYYgdyy YGLDVWGQGTTVTVSSGGGGSGGGGSGGGGSGGGGSDIQMT QSPSSLSASVGDRVTITCRASQGINNFLAWFQQKPGKAPKSLIY AASSLQSGVPSKFSGSGSGTDFTLTIRSLQPEDFATYYCQHYNS YPITFGQGTRLEIKTTTPAPRPPTPAPTIASQPLSLRPEACRPAA GGAVHTRGLDFACDIYIWAPLAGTCGVLLLSLVITLYCKRGR KKLLYIFKQPFMRPVQTTQEEDGCSCRFPEEEEGGCELRVKFS RSADAPAYQQGQNQLYNELNLGRREEYDVLDKRRGRDPEMG GKPRRKNPQEGLYNELQKDKMAEAYSEIGMKGERRRGKGHD GLYQGLSTATKDTYDALHMQALPPR |
| 676 | CD8α signal sequence, 11F4 scFv, CD8α hinge and transmembrane regions, 41BB cytoplasmic signaling domain, CD3ζ cytoplasmic signaling domain | MALPVTALLLPLALLLHAARPQVHLQESGPGLVKPSETLSLTC TVSGGSISHYYWTWIRQPPGKGLEWIGYIYYSGITNFSPSLKSR VSISVDSSKNQFSLNLNSVTAADTAVYYCAGISLAgEYFDYWV QGTLVTVSSGGGGSGGGGSGGGGSGGGGSEIVLTQSPGTLSLS PGERATLSCRASQSVSRSYLAWYQQKPGQAPRLLIYGASSRAT GVPDRFSGSGSGTDFTLTISRLEPEDFAVFYCQQYSISPLTFGG GTKVEIKTTTPAPRPPTPAPTIASQPLSLRPEACRPAAGGAVHT RGLDFACDIYIWAPLAGTCGVLLLSLVITLYCKRGRKKLLYIF KQPFMRPVQTTQEEDGCSCRFPEEEEGGCELRVKFSRSADAPA YQQGQNQLYNELNLGRREEYDVLDKRRGRDPEMGGKPRRK NPQEGLYNELQKDKMAEAYSEIGMKGERRRGKGHDGLYQGL STATKDTYDALHMQALPPR |

TABLE 7-continued

CAR amino acid sequences

| SEQ ID NO: | Name/ Component | Sequence |
|---|---|---|
| 677 | CD8α signal sequence, 10E12 scFv, CD8α hinge and transmembrane regions, 41BB cytoplasmic signaling domain, CD3ζ cytoplasmic signaling domain | MALPVTALLLPLALLLHAARPQVQLQESGPGLVKPSETLSLTC TVSGVSISSYYWSWIRQPPGKGLEWIAYIYYSGNTNYSPSLKS RVTISVDTSKDQLSLKLSSVTAADTAVYYCTRGGSGtiDVFDIW GQGTMVAVSSGGGGSGGGGSGGGGSGGGGSQSVLTQPPSVS AAPGQKVTISCSGSSSNIGNNYVSWYQQLPGTAPKLLIYDNNK RPSGIPDRFSGSKSGTSATLGITGLQTGDEADYYCETWDSSLSA VVFGGGTKLTVLTTTPAPRPPTPAPTIASQPLSLRPEACRPAAG GAVHTRGLDFACDIYIWAPLAGTCGVLLLSLVITLYCKRGRK KLLYIFKQPFMRPVQTTQEEDGCSCRFPEEEEGGCELRVKFSR SADAPAYQQGQNQLYNELNLGRREEYDVLDKRRGRDPEMGG KPRRKNPQEGLYNELQKDKMAEAYSEIGMKGERRRGKGHDG LYQGLSTATKDTYDALHMQALPPR |
| 678 | CD8α signal sequence, 4E1 scFv, CD8α hinge and transmembrane regions, 41BB cytoplasmic signaling domain, CD3ζ cytoplasmic signaling domain | MALPVTALLLPLALLLHAARPQVQLQQSGPGLVKPSQTLSLTC AISGDNVSTnsAAWNWIRQSPSRGLEWLGWTYYRSKwyNDYA VSLKSRININPDTSKNQFSLQLNSVTPEDTAVYYCARWVNRD VFDIWGQGTMVTVSSGGGGSGGGGSGGGGSGGGGSQSALTQ PASVSGSPGQSITISCTGTSSDVGSYNLVSWYQQHPGKAPKLM IYEGSKRPSGVSNRFSGSKSGNTASLTISGLQAEDEADYYCCS YAGSSTWVFGGGTKLTVLTTTPAPRPPTPAPTIASQPLSLRPEA CRPAAGGAVHTRGLDFACDIYIWAPLAGTCGVLLLSLVITLYC KRGRKKLLYIFKQPFMRPVQTTQEEDGCSCRFPEEEEGGCELR VKFSRSADAPAYQQGQNQLYNELNLGRREEYDVLDKRRGRD PEMGGKPRRKNPQEGLYNELQKDKMAEAYSEIGMKGERRRG KGHDGLYQGLSTATKDTYDALHMQALPPR |
| 679 | CD8α signal sequence, 2404.6H1 scFv, CD8α hinge and transmembrane regions, 41BB cytoplasmic signaling domain, CD3ζ cytoplasmic signaling domain | MALPVTALLLPLALLLHAARPQVQLVESGGGVVQPGRSLRLS CAASGFTFSSYGMHWVRQTPGKGLEWVAVISYDGNsNYYAD SVKGRFTISRDNSKNTLYLQMNSLRAEDTAVYYCARDGATvts yyyYGMDVWGQGTTVTVSSGGGGSGGGGSGGGGSGGGGSEI VLTQSPGTLSLSPGERATLSCRASQSVSRTYLAWYHQKPGQAP RLLIYGASSRATGISDRFSGSGSGTDFTLTISRLEPEDFAVYYCQ QYGTSPITFGQGTRLEIKTTTPAPRPPTPAPTIASQPLSLRPEAC RPAAGGAVHTRGLDFACDIYIWAPLAGTCGVLLLSLVITLYCK RGRKKLLYIFKQPFMRPVQTTQEEDGCSCRFPEEEEGGCELRV KFSRSADAPAYQQGQNQLYNELNLGRREEYDVLDKRRGRDP EMGGKPRRKNPQEGLYNELQKDKMAEAYSEIGMKGERRRGK GHDGLYQGLSTATKDTYDALHMQALPPR |
| 680 | CD8α signal sequence, 2A8 scFv, CD8α hinge and transmembrane regions, 41BB cytoplasmic signaling domain, CD3ζ cytoplasmic signaling domain | MALPVTALLLPLALLLHAARPQVQLQQSGPGLVKPSQTLSLTC AISGDSVSSnsAVWNWIRQSPSRGLEWLGRTYYRSKwyNDYA VSVKSRITINPDTSRNQFSLQLNSVTPEDTAVYYCARGGIVgap DGFDIWGQGTMVTVSSGGGGSGGGGSGGGGSGGGGSDIVMT QSPDSLAVSLGERATINCKSSQSVLDSSNNNnYFAWYQQRPGQ PPHLLIYWASSRESGVPDRFSGSGSGTDFTLTISSLQAEDVAVY YCQQYYSTPYTFGQGTKLEIKTTTPAPRPPTPAPTIASQPLSLRP EACRPAAGGAVHTRGLDFACDIYIWAPLAGTCGVLLLSLVITL YCKRGRKKLLYIFKQPFMRPVQTTQEEDGCSCRFPEEEEGGCE LRVKFSRSADAPAYQQGQNQLYNELNLGRREEYDVLDKRRG RDPEMGGKPRRKNPQEGLYNELQKDKMAEAYSEIGMKGERR RGKGHDGLYQGLSTATKDTYDALHMQALPPR |
| 681 | CD8α signal sequence, 3B1 scFv, CD8α hinge and transmembrane regions, 41BB cytoplasmic signaling domain, CD3ζ cytoplasmic signaling domain | MALPVTALLLPLALLLHAARPQVQLQQSGPGLVKPSQTLSLTC AISGDSVSSntTAWKWSRQSPSKGLEWLGWTYYRSKwyYDYT VSVKSRITINPDTSKNQFSLQLNSVTPEDTAVYYCARWIFHDA FDIWGQGTMVTVSSGGGGSGGGGSGGGGSGGGGSQSALTQP PSASGTPGQRVTISCSGSSSNIGSNTVNWYQQLPGTAPKLLIYT NNQRPSGVPDRFSGSKSGTSASLAISGLQSEDEADYFCSTWDD SLNGPVFGGGTKLTVLTTTPAPRPPTPAPTIASQPLSLRPEACRP AAGGAVHTRGLDFACDIYIWAPLAGTCGVLLLSLVITLYCKR GRKKLLYIFKQPFMRPVQTTQEEDGCSCRFPEEEEGGCELRVK FSRSADAPAYQQGQNQLYNELNLGRREEYDVLDKRRGRDPE MGGKPRRKNPQEGLYNELQKDKMAEAYSEIGMKGERRRGK GHDGLYQGLSTATKDTYDALHMQALPPR |
| 682 | CD8α signal sequence, 9B5 scFv, CD8α hinge and transmembrane regions, 41BB cytoplasmic | MALPVTALLLPLALLLHAARPQVQLESGPGLVKPSETLSLTC TVSGDSISSLSWSWIRQTPGEGLEWIGYLYYSGSTDYNPSLKS RVTISVDTSKNQFSLKLRSVAAADTALYYCARGRRAFDIWGQ GTMVTVSSGGGGSGGGGSGGGGSGGGGSDIQMTQSPSSLSAS VGDRVTITCRGSQGISNYLAWFQQRPGKAPKSLIYAASSLESG VPSKFSGSGSGTDFTLTIISLQPEDFATYYCQQYYNYPITFGQG |

TABLE 7-continued

CAR amino acid sequences

| SEQ ID NO: | Name/Component | Sequence |
|---|---|---|
| | signaling domain, CD3ζ cytoplasmic signaling domain | TRLEIKTTTPAPRPPTPAPTIASQPLSLRPEACRPAAGGAVHTR GLDFACDIYIWAPLAGTCGVLLLSLVITLYCKRGRKKLLYIFK QPFMRPVQTTQEEDGCSCRFPEEEEGGCELRVKFSRSADAPAY QQGQNQLYNELNLGRREEYDVLDKRRGRDPEMGGKPRRKNP QEGLYNELQKDKMAEAYSEIGMKGERRRGKGHDGLYQGLST ATKDTYDALHMQALPPR |
| 683 | CD8α signal sequence, 11A5 scFv, CD8α hinge and transmembrane regions, 41BB cytoplasmic signaling domain, CD3ζ cytoplasmic signaling domain | MALPVTALLLPLALLLHAARPQVQLVQSGAEVKKPGASVKVS CKASGYTFTGYYMHWVRQAPGQGLEWMGWINpNSGGTNYA QKFQGRVTMTRDTSVSTAYMELSRLTSDDTAIYYCAKDGGGd fyfYGMDVWGQGTTVTVSSGGGGSGGGGSGGGGSGGGGSQT VVTQEPSFSVSPGGTVTLTCGLSSGSVSTSYYPSCFQQTPGQAP RTLIYSTDTRSSGVPDRFSGSILGNKAALTITGAQADDESDYYC VLYMGSGISVFGGGTKLTVLTTTPAPRPPTPAPTIASQPLSLRP EACRPAAGGAVHTRGLDFACDIYIWAPLAGTCGVLLLSLVITL YCKRGRKKLLYIFKQPFMRPVQTTQEEDGCSCRFPEEEEGGCE LRVKFSRSADAPAYQQGQNQLYNELNLGRREEYDVLDKRRG RDPEMGGKPRRKNPQEGLYNELQKDKMAEAYSEIGMKGERR RGKGHDGLYQGLSTATKDTYDALHMQALPPR |

Figure 3A:
Figure 3A:
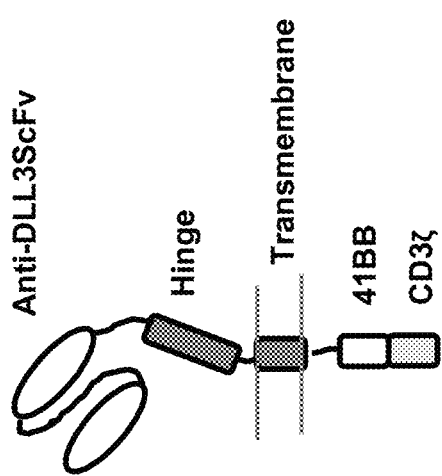

A schematic of the CAR structure is set forth in FIG. 3A. Representative CAR sequences reformatted from anti-DLL3 clones are included in SEQ ID NO 482 to 533. Codon-optimized DLL3 CAR sequences were synthesized and subcloned into the following lentiviral vectors pLVX-EF1a-DLL3 CAR (Clontech) using the XmaI (5') and MluI (3') restriction sites.

To generate DLL3 CAR-T cells, PBMCs were first purified from buffy coat samples using Ficoll gradient density medium (Ficoll Paque PLUS/GE Healthcare Life Sciences). T cells were purified from PBMCs using a commercially available T cell isolation kit (Miltenyi Biotec, Cat #130-096-535). Alternatively, primary human T cells can be directly purified from LeukoPak (StemCell Technologies).

To make lentivirus encoding DLL3 CARs, HEK-293T cells were plated at 0.4 million cells per mL in 2 mL of DMEM (Gibco) supplemented with 10% FBS (Hyclone or JR Scientific) per well of a 6-well plate on Day 0. On Day 1, the lentivirus was prepared by mixing together lentiviral packaging vectors 1.5 ug psPAX2, 0.5 ug pMD2G, and 0.5 ug of the appropriate transfer CAR vector in 250 uL Opti-MEM (Gibco) per well of the 6-well plate ("DNA mix"). 10 uL Lipofectamine 2000 (Invitrogen) in 250 uL Opti-MEM was incubated at room temperature for 5 minutes and then added to the DNA mix. The mixture was incubated at room temperature for 20 minutes and the total volume of 500 uL was slowly added to the sides of the wells containing HEK-293T. Purified T cells were activated in X-Vivo-15 medium (Lonza) supplemented with 100 IU/mL human IL-2 (Miltenyi Biotec), 10% FBS (Hyclone), and human T Trans-Act (Miltenyi Biotec, Cat #130-111-160, 1:100 dilution). On Day 2, the media from each well of the 6-well plate was replaced with 2 mL per well of T cell transduction media, i.e., X-Vivo-15 supplemented with 10% FBS. On Day 3, T cells were resuspended at 0 5 million cells per mL in 1 mL of T cell transduction media per well of a Grex-24 plate (Wilson Wolf, cat #80192M). The lentiviral supernatants from HEK293T cells were harvested and passed through a 0.45 micron filter (EMD Millipore) to remove cell debris, and then added to the T cells along with 100 IU/mL human IL-2. On Day 5, 4.5 mL of T cell expansion media, i.e., X-Vivo-15 supplemented with 5% human AB serum (Gemini Bio) was added to each well of a Grex-24 plate. On Day 9 and Day 13, transduction efficiency was determined by detecting the percentage of T cells that recognize recombinant DLL3 (Adipogen) using flow cytometry. Cells were expanded into larger flasks or G-Rex vessels (Wilson Wolf) as needed using T cell expansion media. On Day 14, DLL3 CAR-T cells were cryopreserved. Percentage of cells stained with recombinant DLL3 was normalized across clones right before cryopreservation.

To determine the percentage of T cells that were successfully transduced with DLL3 CAR, T cells were first incubated with 1 ug/ml Flag tagged recombinant DLL3 (Adipogen) in PBS+1% BSA for 20 minutes at 4 C. Then cells were washed with PBS+1% BSA, stained with PE labelled anti-Flag antibodies (Biolegend, Cat #637310) and analyzed using flow cytometry.

Figure 3B:
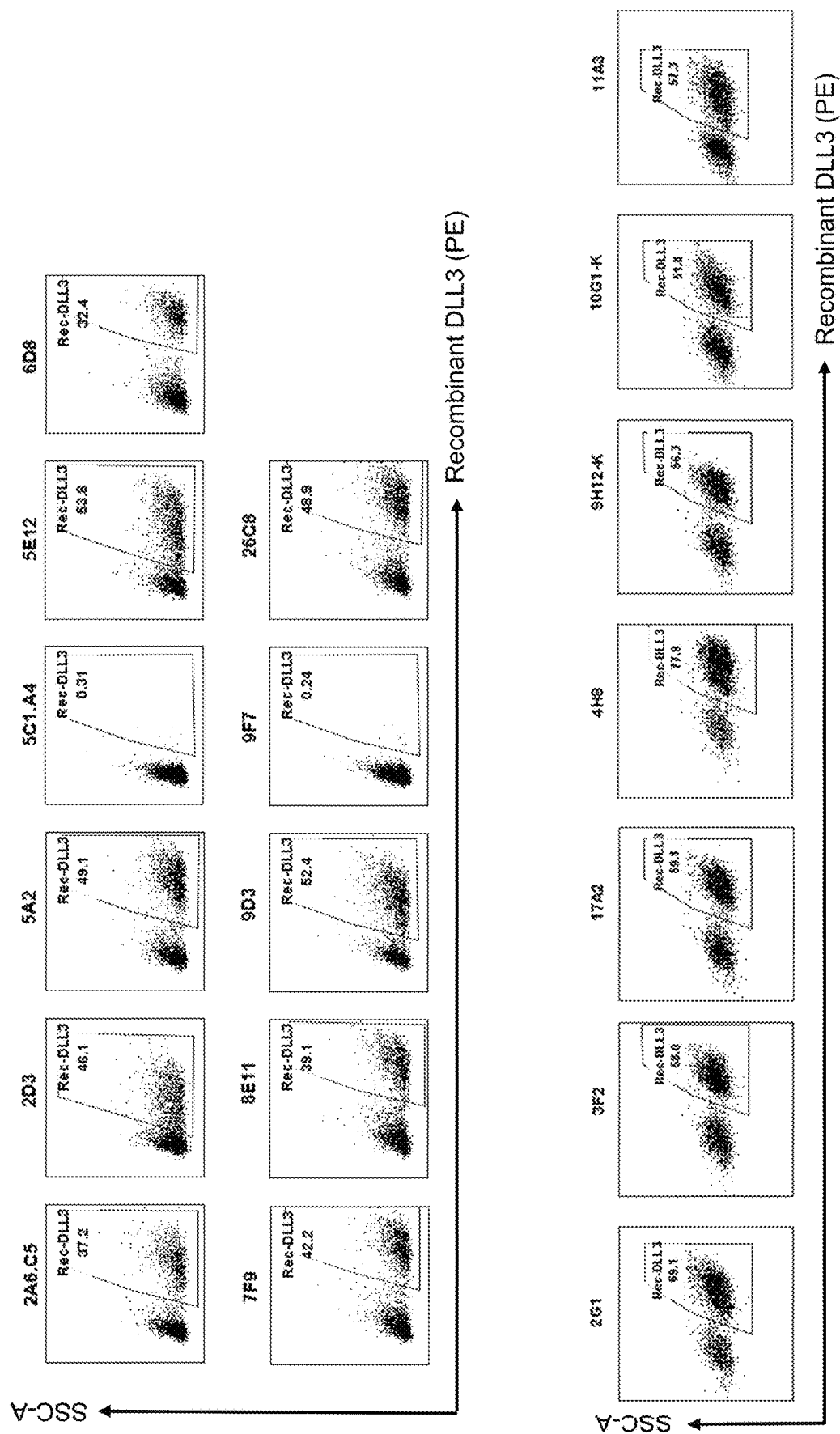

Examples of DLL3 CAR-T cells are shown in FIG. 3B. FIG. 3B shows experimental data, showing anti-DLL3 CARs are expressed on the surface of primary T-cells and can recognize recombinant DLL3. The plots are gated on live CD3+ cells. The numbers on the plots are the percentage of cells expressing each anti-DLL3 CAR.

Example 6: In Vitro Characterization

This example describes experiments used to determine the specificity and in vitro activity of CARs for DLL3.

SHP-77, WM266.4, DMS 454 and DMS 273 are DLL3+ cells lines that were purchased from ATCC or Sigma. HEK-293T is a DLL3 negative cell line. To express human DLL3 in HEK-293T, lentivirus encoding full length human DLL3 was used to transduce HEK-293T cells.

To test DLL3-specific killing, firefly luciferase expressing HEK-293T cells with or without human DLL3 expression were then plated at a seeding density of 5,000 cells per well in 96-well assay plates (Costar). DLL3 CAR-T cells were thawed and added to plated HEK-293T cells with or without human DLL3 expression at effector:target (E:T) ratio ranging from 1:9 to 9:1 in T cell expansion media, i.e., X-Vivo-15 supplemented with 5% human AB serum (Gemini Bio). Cell viability was measured after 72 hours using one-glo assay kit (Promega). Representative DLL3 CAR-T cells demonstrated potent killing on HEK-293T-DLL3 cells but did not show detectable activity in HEK-293T parental cells (FIG. 4A).

To test the cytotoxic activity of DLL3 CAR-T cells against cell lines that express endogenous DLL3, DLL3 CAR-T cells were incubated with firefly luciferase labelled DLL3+ SHP-77, WM266.4, DMS 454 or DMS 273 cells at effector:target (E:T) ratio ranting from 1:9 to 9:1 in T cell expansion media, i.e., X-Vivo-15 supplemented with 5% human AB serum (Gemini Bio). Cell viability was measured after 72 hours using one-glo assay kit (Promega). Each condition was assayed in 3 replicates. Average percentage of live cells and standard deviation were plated (FIG. 4B and FIG. 4C).

Figure 4A:
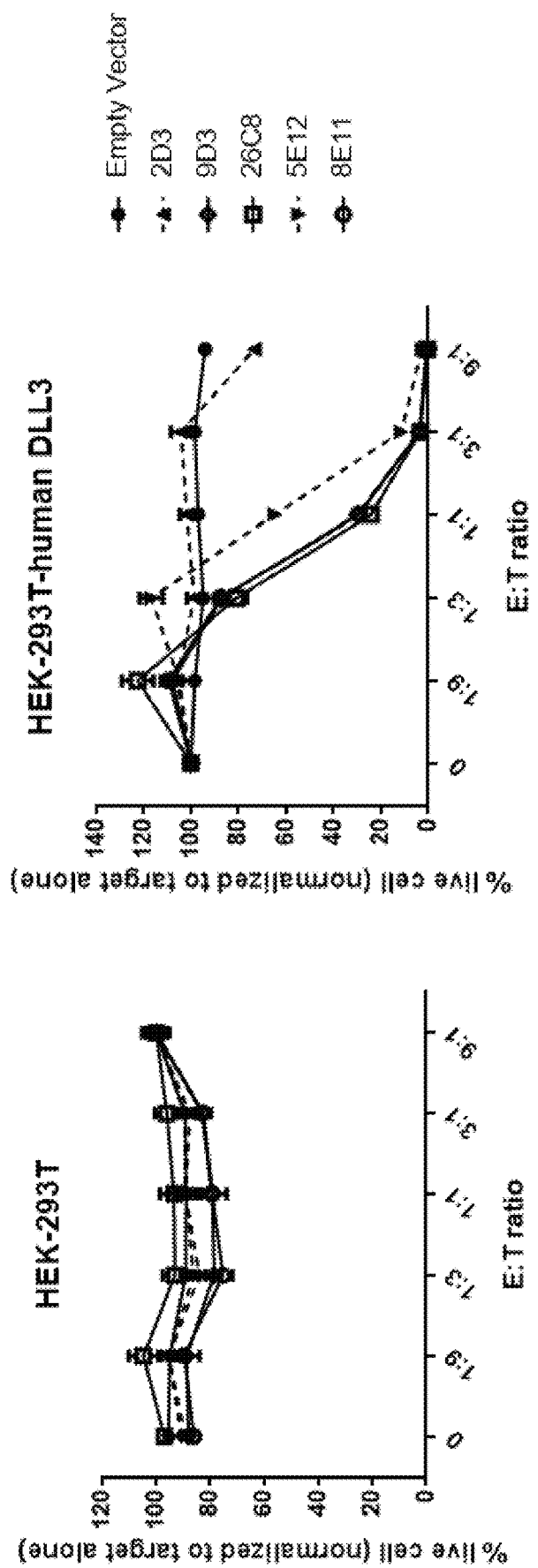
FIGS. 4A-4C are a series of plots showing killing data for some anti-DLL3 CARs.

FIG. 4A shows experimental data showing anti-DLL3 CAR-T cells specifically killed HEK-293T cells expressing human DLL3 but not parental HEK-293T cells in a 3-day cytotox assay at indicated effector:target ratios. T cells that didn't express anti-DLL3 CARs (labelled empty vector) were used as negative control.

Figure 4B:
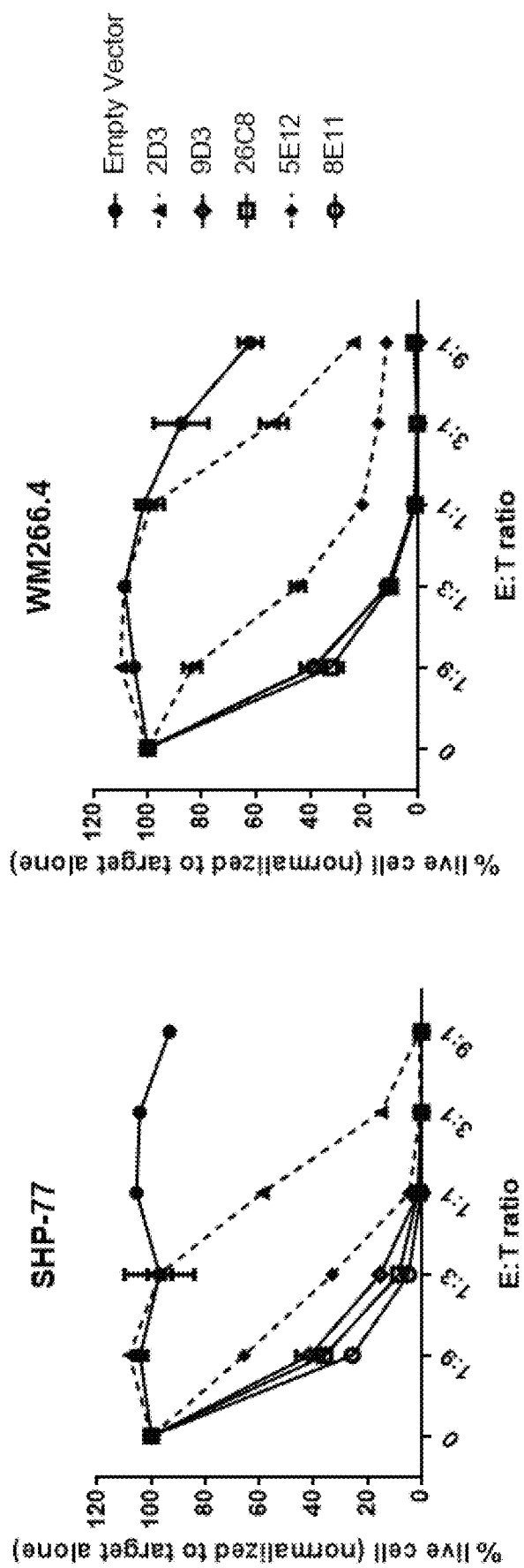

FIG. 4B shows experimental data showing anti-DLL3 CAR-T cells killed SHP-77 and WM266.4 cells that expresses endogenous DLL3 in a 3-day cytotox assay at indicated effector:target ratios.

Figure 4C:
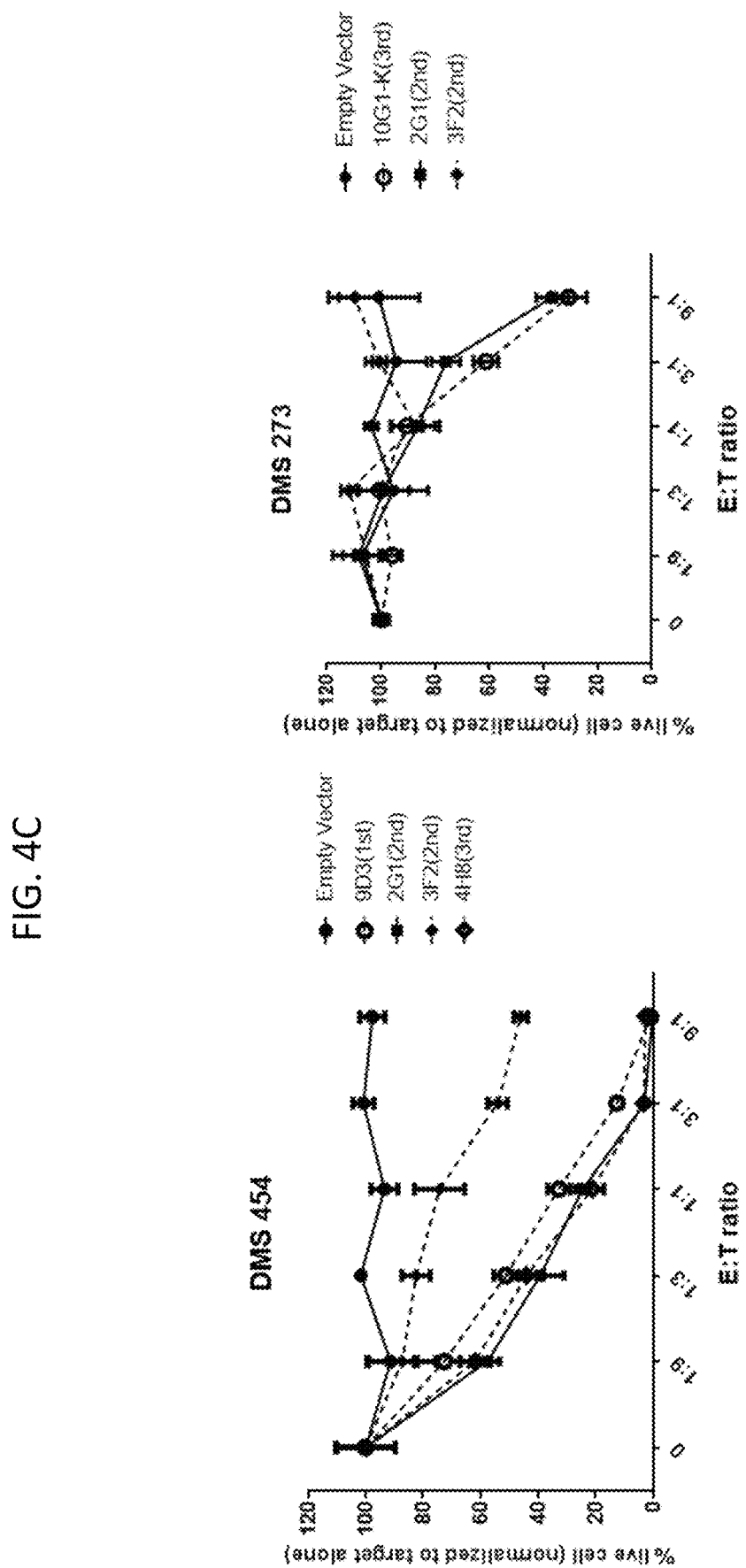

FIG. 4C shows experimental data showing anti-DLL3 CAR-T cells killed DMS 454 and DMS 273 small cell lung cancer cells that expresses endogenous DLL3 in a 3-day cytotox assay at indicated effector:target ratios. For all plots in FIG. 4C, One-glo assay system was used to assess target cell viability, n=3.

Figure 5:
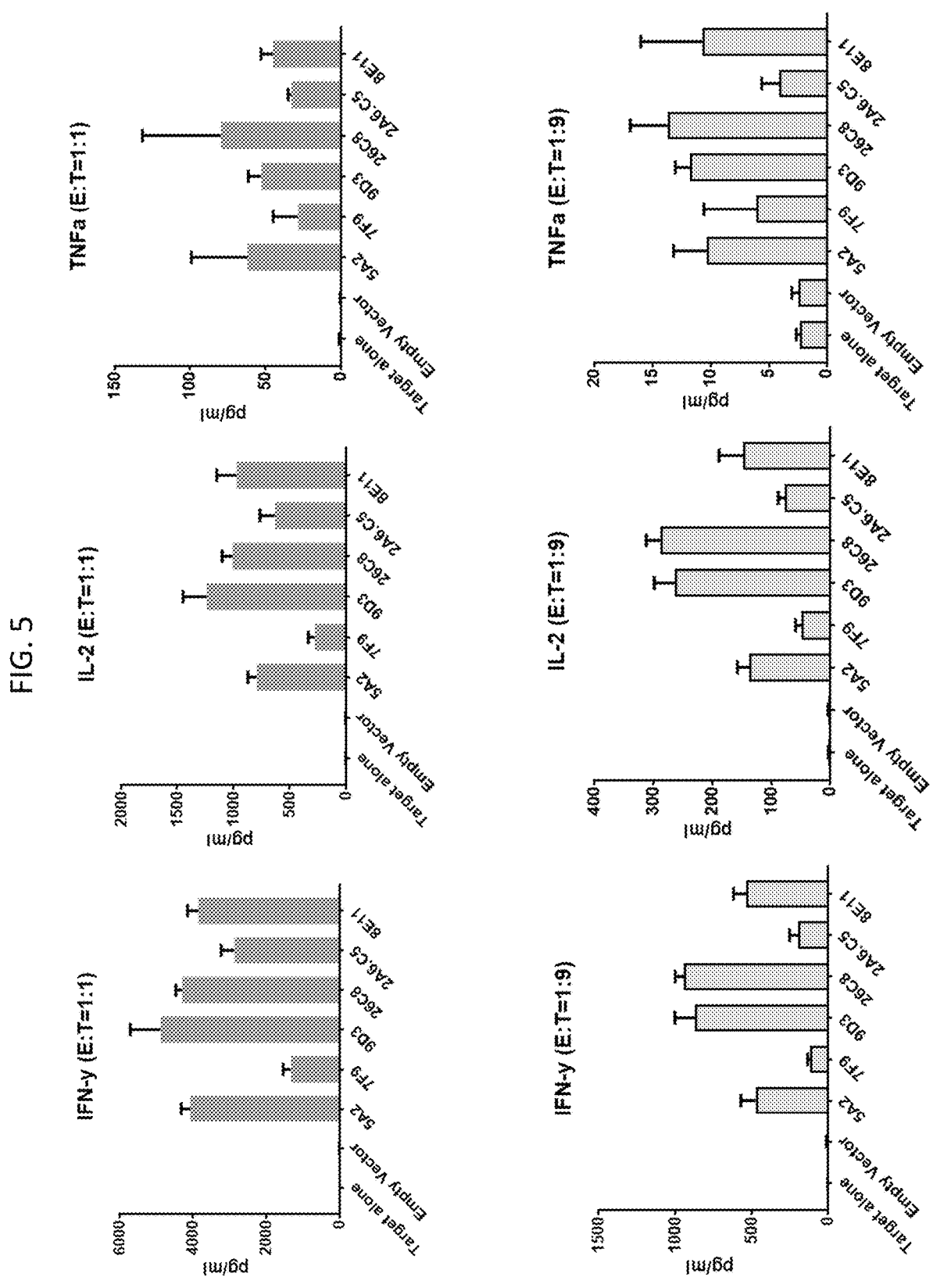

To measure cytokines secreted from DLL3 CAR-T cells, DLL3 CAR-T cells were incubated with DLL3+ SHP-77 cells at effector:target (E:T) ratio of 1:1 or 1:9 in T cell expansion media, i.e., X-Vivo-15 supplemented with 5% human AB serum (Gemini Bio). 24 hours later, tissue culture supernatant was collected and the levels of 3 cytokines [interferon gamma (IFN-γ), tumor necrosis factor alpha (TNF-α), and IL-2] in the supernatants were measured using human proinflammatory tissue culture 9-plex assay (MSD) following manufacturer's protocol. FIG. 5 shows Anti-DLL3 CAR-T cells released cytokines after co-incubation with DLL3-expressing SHP-77 cell line. CAR-T cells and SHP-77 cells were incubated at 1:1 or 1:9 effector:target ratio for 24 hours, n=3.

Example 7: Serial Killing Assay

A serial killing assay involves repeated exposure of CAR-T cells to their target causing the CAR-T cells to undergo proliferation and in certain cases, differentiation and exhaustion. This assay was used to select optimal clones with high target cell lysis and proliferative abilities after several rounds of exposure to target cells.

Figure 6A:
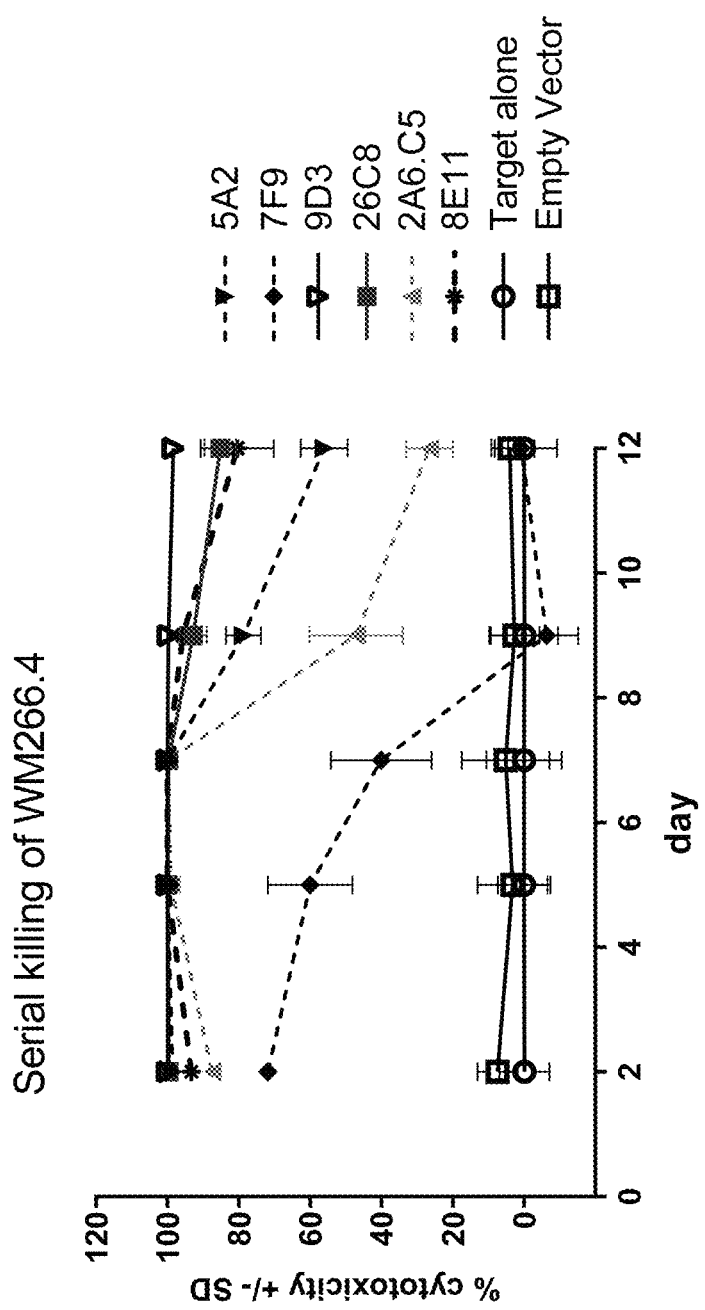

One the first day of the assay, 5,000 firefly luciferase labelled WM266.4, DMS 454 or DMS 273 cells that are known to express DLL3 were seeded in 96-well plates with white wall and flat clear bottom in 100 ul X-Vivo-15 medium with 5% of human serum. After target cells attached to the bottom of the plates, DLL3 CAR-T cells were thawed and added to plated target cells at an effector:target (E:T) ratio of 1:1 in X-VIVO medium with 5% of human serum. Every 2 days thereafter, 100 μl medium containing DLL3 CAR-T cells were transferred to freshly plated target cells and percentage lysis of previously plated target cells were determined using one-glo assay system or CellTiter-glo system (Promega). Each condition was assayed in 3 to 6 replicates. Average percentage of lysis and standard deviation were plated (FIGS. 6A-6C). Optimal clones were those with highest target cell lysis during the entire assay on day 12. These data show experimental data of serial killing assay to show that after repeated exposure of anti-DLL3 CAR-T cells to DLL3+WM266.4 cells, some of the clones remained active. One-glo assay system or CellTiter-glo was used at each indicated time point to assess target cell viability, n=3-6.

Example 8: In Vivo Activity

Figure 7A:
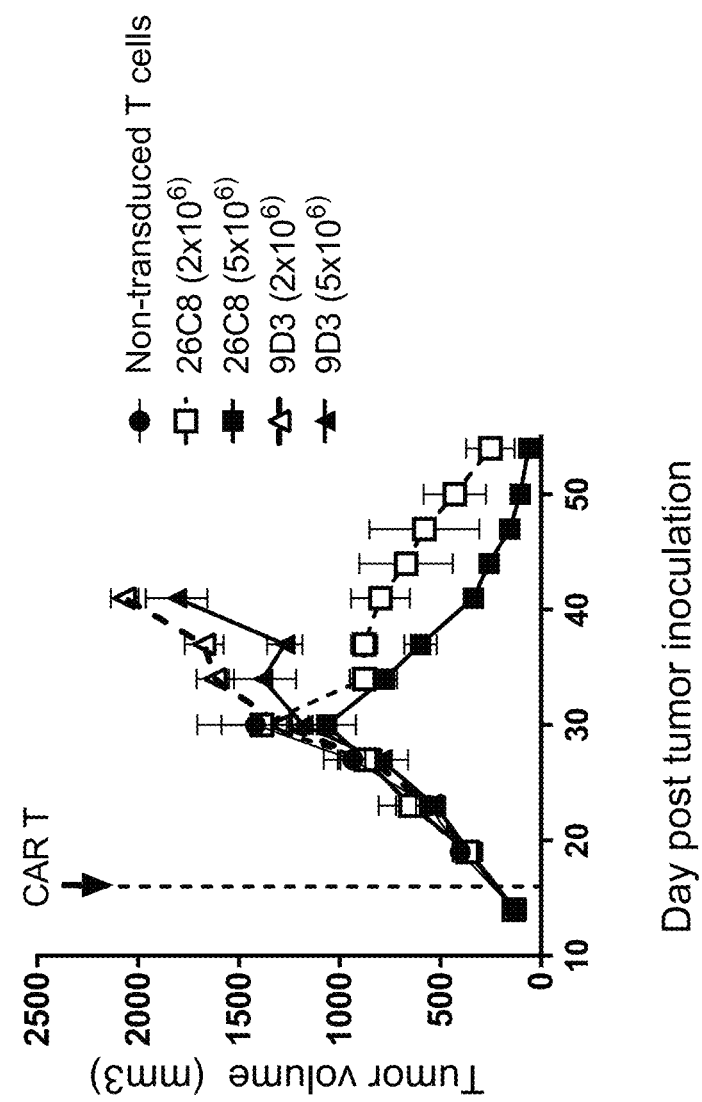
FIGS. 7A-7B are plots demonstrating that anti-DLL3 CAR-T cells eliminated established SHP-77 small cell lung cancer subcutaneous tumors in mice in a dose dependent manner.
Figure 7B:
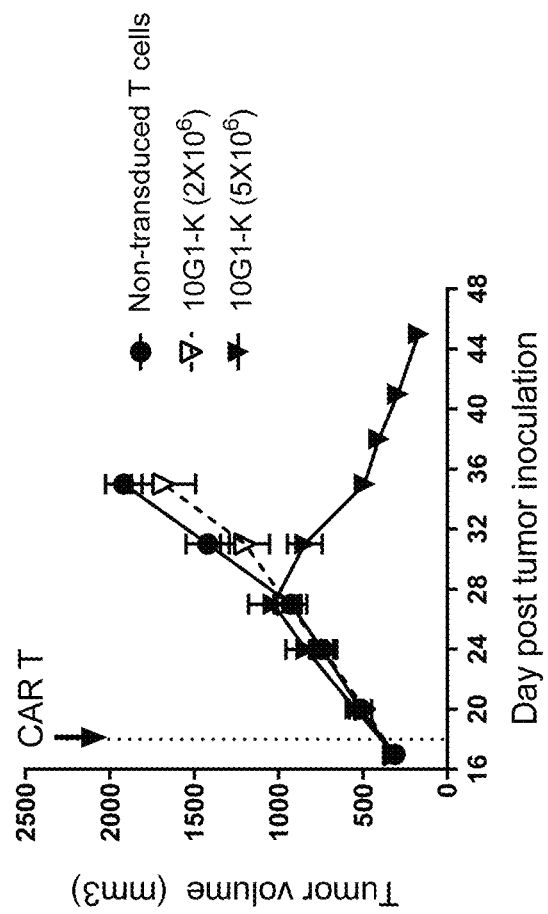

To test the anti-tumor activity of DLL3 CAR-T cells, SHP-77 tumor bearing NSG mice were used. SHP-77 cells were obtained from a frozen stock vial, thawed and counted according to standard procedure. Cells were diluted to $50 \times 10^6$ viable cells/mL in complete growth medium (RPMI+10% FBS). Cell suspension was kept on ice until implantation Immediately before implanting, cells were mixed 1:1 with BD Matrigel Matrix (cat #354234) and 200 μL of cells/matrigel suspension containing $5 \times 10^6$ SHP-77 cells was injected per mouse subcutaneously. Tumor growth was monitored by caliper measurements using a digital caliper starting from Day 5 post-implantation. Tumor size was calculated using the formula Tumor volume=(width$^2 \times$ length/2). Mice were randomized into groups of 5 based on tumor volume about two weeks post-implantation. Average tumor volume per group was 314 mm$^3$ or less. One day after mice were randomized, Non-transduced T cells and DLL3 CAR-T cells were thawed and counted according to standard procedure. Cells were resuspended in RPMI+10% FBS and injected at doses 2 or 5 million CAR+ cells/mouse by tail vein IV injection in a volume of 200 uL/mouse. Tumors continued to be monitored every 3-4 days until the end of the study. 26C8 and 10G1-K DLL3 CAR-T cells induced tumor inhibition in a dose dependent manner (FIG. 7A-7B) FIG. 7A-7B shows experimental data showing anti-DLL3 CAR-T cells can eliminate established small cell lung cancer tumors in mice in a dose dependent manner.

Figure 8:
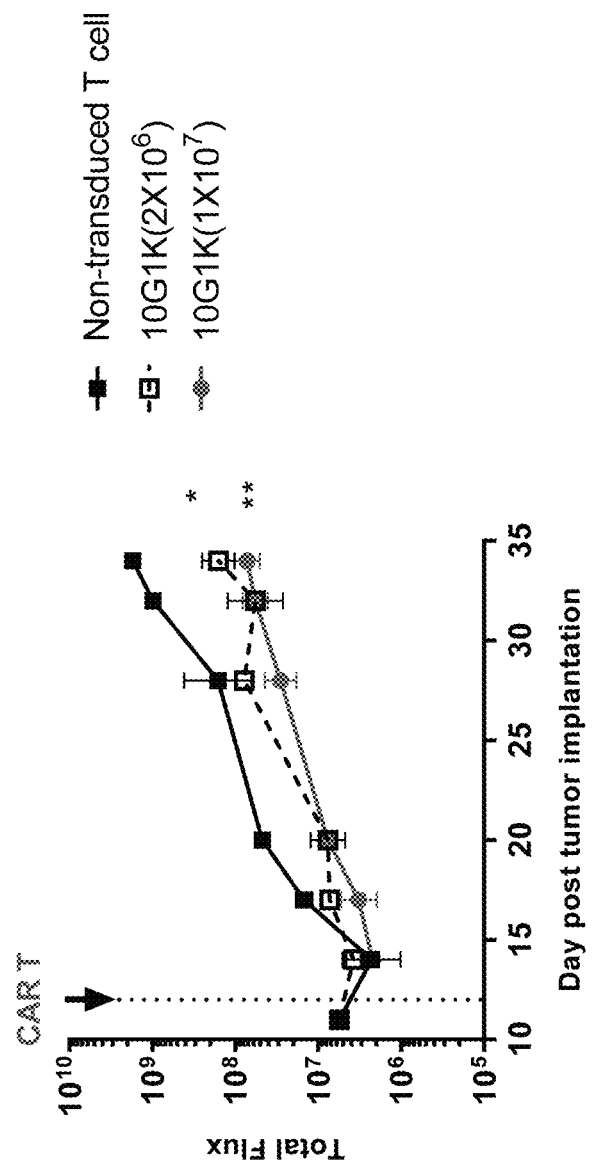
FIG. 8 is a plot demonstrating that 10G1-K anti-DLL3 CAR-T cells inhibited the growth of established IV injected SHP-77 small cell lung cancer tumors in a dose dependent manner. Statistical analysis was done using ANOVA with repeated measures (Dunnett's multiple comparisons), day 14-day 28, n=4-5. *, p<0.05. **, p<0.01.

To test anti-tumor activity of DLL3 CAR-T cells in models that show metastasis similar to human disease, SHP-77 tumors were established with tail vein injection. Tumors were observed in lung, liver, brain, kidney and spleen. Specifically, SHP-77 cells were thawed and diluted to $40 \times 10^6$ viable cells/mL in complete growth medium (RPMI+10% FBS). Cell suspension was kept on ice until implantation and 200 uL of cell suspension was injected per mouse by tail vein IV. On day 7 post-implantation, 200 uL Luciferin (15 mg/mL) was injected and tumor growth was monitored by IVIS imaging., Mice were randomized into groups of 5 based on Total Flux on Day 11 post-implantation. On Day 12 post-implantation, CAR-Ts were thawed and counted according to standard procedure. Cells were resuspended in RPMI+10% FBS and injected at 2 or 7 million CAR+ cells per mouse by tail vein IV injection in a volume of 200 uL per mouse. Tumors continued to be monitored every 3-4 days until the end of the study. As shown in FIG. 8, 10G1-K anti-DLL3 CAR-T cells can inhibit established small cell lung cancer tumors in mice in a dose dependent manner.

Example 9: Anti-DLL3 CAR Constructs with a Safety Switch

This example describes the construction, expression and cytotoxic activity of anti-DLL3 CAR with safety switch. The anti-DLL3 CARs in Table 6 were reformatted to include different safety switches structures listed below (Table 8).

TABLE 8

Structure of safety switches

| Format | Structure |
|---|---|
| QR3 | CD8α signal sequence - linker - CD20 mimotope - linker - anti-DLL3 ScFv - linker - CD20 mimotope - linker - QBEND-10 epitope - linker - CD20 mimotope - hinge and transmembrane regions of human CD8 α molecule - 41BB signaling domain - CD3ζ signaling domain |
| SR2 | CD8α signal sequence - anti-DLL3 ScFv - linker - CD20 mimotope - linker- CD20 mimotope -linker - hinge and transmembrane regions of human CD8 α molecule - 41BB signaling domain - CD3ζ signaling domain |
| RSR | CD8α signal sequence - linker - CD20 mimotope - linker - anti-DLL3 ScFv - linker - CD20 mimotope - linker - hinge and transmembrane regions of human CD8 α molecule - 41BB signaling domain - CD3ζ signaling domain |
| R2S | CD8α signal sequence - linker - CD20 mimotope - linker- CD20 mimotope - linker - anti-DLL3 ScFv- linker-hinge and transmembrane regions of human CD8 α molecule - 41BB signaling domain - CD3ζ signaling domain |

Protein sequences encoding anti-DLL3 CAR constructs including a safety switch are shown in Table 9. Exemplary safety switch constructs may comprise the CD8α signal sequence (SEQ ID NO: 477), an anti-DLL3 scFv described herein, CD20 mimotope (SEQ ID NO: 536), QBEND-10 epitope (SEQ ID NO: 544), hinge and transmembrane regions of the human CD8α molecule (SEQ ID NO: 479), the cytoplasmic portion of the 4-1BB molecule (SEQ ID NO: 291) and the cytoplasmic portion of the CD3ζ molecule (SEQ ID NO: 292).

TABLE 9

CAR and safety switch amino acid sequences

| SEQ ID NO | Name / Component | Sequence |
|---|---|---|
| 622 | 2G1-QR3 CD8α signal sequence, CD20 mimotope, 2G1 ScFv, CD20 mimotope, QBEND-10 epitope, CD20 mimotope, hinge and transmembrane regions of human CD8 α molecule, 41BB signaling domain, CD3ζ signaling domain | MALPVTALLLPLALLLHAARPGGGGSCPYSNPSLCSGGGGSG GGGSQLQLQESGPGLVKPSETLSLTCTVSGGSISSSSYYWGWI RQPPGKGLEWIGSIYYSGNIYHNPSLKSRVSISVDTSKNQFSLR LSSVTAADTAVYYCAREIIVGATHFDYWGQGTLVTVSSGGGG SGGGGSGGGGSGGGGSAIQMTQSPSSLSASVGDRVTITCRASQ GIRNDLGWYQQKPGKAPELLIYAASSLQSGVPSRFSGSGSGTD FTLTISSLQPEDFATYYCLQDYNYPLTFGPGTKVDIKGSGGGGS CPYSNPSLCSGGGGSELPTQGTFSNVSTNVSPAKPTTTACPYSN PSLCTTTPAPRPPTPAPTIASQPLSLRPEACRPAAGGAVHTRGL DFACDIYIWAPLAGTCGVLLLSLVITKRGRKKLLYIFKQPFMRP VQTTQEEDGCSCRFPEEEEGGCELRVKFSRSADAPAYQQGQN QLYNELNLGRREEYDVLDKRRGRDPEMGGKPRRKNPQEGLY NELQKDKMAEAYSEIGMKGERRRGKGHDGLYQGLSTATKDT YDALHMQALPPR |
| 623 | 2G1-SR2 CD8α signal sequence, 2G1 ScFv, CD20 mimotope, CD20 mimotope, hinge and transmembrane regions of human CD8 α molecule, 41BB signaling domain, CD3ζ signaling domain | MALPVTALLLPLALLLHAARPQLQLQESGPGLVKPSETLSLTC TVSGGSISSSSYYWGWIRQPPGKGLEWIGSIYYSGNIYHNPSLK SRVSISVDTSKNQFSLRLSSVTAADTAVYYCAREIIVGATHFDY WGQGTLVTVSSGGGGSGGGGSGGGGSGGGGSAIQMTQSPSSL SASVGDRVTITCRASQGIRNDLGWYQQKPGKAPELLIYAASSL QSGVPSRFSGSGSGTDFTLTISSLQPEDFATYYCLQDYNYPLTF GPGTKVDIKGSGGGGSCPYSNPSLCSGGGGSCPYSNPSLCSGG GGSTTTACPYSNPSLCTTTPAPRPPTPAPTIASQPLSLRPEACRP AAGGAVHTRGLDFACDIYIWAPLAGTCGVLLLSLVITKRGRK KLLYIFKQPFMRPVQTTQEEDGCSCRFPEEEEGGCELRVKFSRS ADAPAYQQGQNQLYNELNLGRREEYDVLDKRRGRDPEMGG KPRRKNPQEGLYNELQKDKMAEAYSEIGMKGERRRGKGHDG LYQGLSTATKDTYDALHMQALPPR |
| 624 | 2G1-RSR CD8α signal sequence, CD20 mimotope, 2G1 ScFv, CD20 mimotope, hinge and transmembrane regions of human CD8 α molecule, 41BB signaling domain, CD3ζ signaling domain | MALPVTALLLPLALLLHAARPGGGGSCPYSNPSLCGGGGSQL QLQESGPGLVKPSETLSLTCTVSGGSISSSSYYWGWIRQPPGKG LEWIGSIYYSGNIYHNPSLKSRVSISVDTSKNQFSLRLSSVTAA DTAVYYCAREIIVGATHFDYWGQGTLVTVSSGGGGSGGGGSG GGGSGGGGSAIQMTQSPSSLSASVGDRVTITCRASQGIRNDLG WYQQKPGKAPELLIYAASSLQSGVPSRFSGSGSGTDFTLTISSL QPEDFATYYCLQDYNYPLTFGPGTKVDIKGGGGSCPYSNPSLC GGGGSTTTPAPRPPTPAPTIASQPLSLRPEACRPAAGGAVHTRG LDFACDIYIWAPLAGTCGVLLLSLVITKRGRKKLLYIFKQPFM RPVQTTQEEDGCSCRFPEEEEGGCELRVKFSRSADAPAYQQG QNQLYNELNLGRREEYDVLDKRRGRDPEMGGKPRRKNPQEG LYNELQKDKMAEAYSEIGMKGERRRGKGHDGLYQGLSTATK DTYDALHMQALPPR |
| 625 | 2G1-R2S CD8α signal sequence, CD20 mimotope, CD20 | MALPVTALLLPLALLLHAARPGGGGSCPYSNPSLCGGGGSCP YSNPSLCGGGGSQLQLQESGPGLVKPSETLSLTCTVSGGSISSS SYYWGWIRQPPGKGLEWIGSIYYSGNIYHNPSLKSRVSISVDTS KNQFSLRLSSVTAADTAVYYCAREIIVGATHFDYWGQGTLVT |

TABLE 9-continued

CAR and safety switch amino acid sequences

| SEQ ID NO | Name / Component | Sequence |
|---|---|---|
| | mimotope, 2G1 ScFv, hinge and transmembrane regions of human CD8 α molecule, 41BB signaling domain, CD3ζ signaling domain | VSSGGGGSGGGGSGGGGSGGGGSAIQMTQSPSSLSASVGDRV TITCRASQGIRNDLGWYQQKPGKAPELLIYAASSLQSGVPSRFS GSGSGTDFTLTISSLQPEDFATYYCLQDYNYPLTFGPGTKVDIK TTTPAPRPPTPAPTIASQPLSLRPEACRPAAGGAVHTRGLDFAC DIYIWAPLAGTCGVLLLSLVITKRGRKKLLYIFKQPFMRPVQTT QEEDGCSCRFPEEEEGGCELRVKFSRSADAPAYQQGQNQLYN ELNLGRREEYDVLDKRRGRDPEMGGKPRRKNPQEGLYNELQ KDKMAEAYSEIGMKGERRRGKGHDGLYQGLSTATKDTYDAL HMQALPPR |
| 626 | 4H8-SR2 CD8α signal sequence, 4H8 ScFv, CD20 mimotope, CD20 mimotope, hinge and transmembrane regions of human CD8 α molecule, 41BB signaling domain, CD3ζ signaling domain | MALPVTALLLPLALLLHAARPQVQLQQSGPGLVKPSQTLSLTC AISGDSVSSNSATWNWIRQSPSRGLEWLGRTYYRSKWYDDYA VSVKSRITINPDTSKNHLSLHLNSVTPEDTAVYYCAGGGLVGA PDGFDVWGQGTMVTVSSGGGGSGGGGSGGGGSGGGGSQSVL TQPPSASGTPGQRVTISCSGSSSNIGSDPVNWYQQLPGTAPKLL IYSNNQRPSGVPDRFSGSKSGTSASLAISGLQSEDEADYYCSA WDDSLNGYVFGTGTKVTVLGSGGGGSCPYSNPSLCSGGGGSC PYSNPSLCSGGGGSTTTACPYSNPSLCTTTPAPRPPTPAPTIASQ PLSLRPEACRPAAGGAVHTRGLDFACDIYIWAPLAGTCGVLLL SLVITKRGRKKLLYIFKQPFMRPVQTTQEEDGCSCRFPEEEEGG CELRVKFSRSADAPAYQQGQNQLYNELNLGRREEYDVLDKR RGRDPEMGGKPRRKNPQEGLYNELQKDKMAEAYSEIGMKGE RRRGKGHDGLYQGLSTATKDTYDALHMQALPPR |
| 627 | 4H8-RSR CD8α signal sequence, CD20 mimotope, 4H8 ScFv, CD20 mimotope, hinge and transmembrane regions of human CD8 α molecule, 41BB signaling domain, CD3ζ signaling domain | MALPVTALLLPLALLLHAARPGGGGSCPYSNPSLCGGGGSQV QLQQSGPGLVKPSQTLSLTCAISGDSVSSNSATWNWIRQSPSR GLEWLGRTYYRSKWYDDYAVSVKSRITINPDTSKNHLSLHLN SVTPEDTAVYYCAGGGLVGAPDGFDVWGQGTMVTVSSGGG GSGGGGSGGGGSGGGGSQSVLTQPPSASGTPGQRVTISCSGSS SNIGSDPVNWYQQLPGTAPKLLIYSNNQRPSGVPDRFSGSKSG TSASLAISGLQSEDEADYYCSAWDDSLNGYVFGTGTKVTVLG GGGSCPYSNPSLCGGGGSTTTPAPRPPTPAPTIASQPLSLRPEAC RPAAGGAVHTRGLDFACDIYIWAPLAGTCGVLLLSLVITKRGR KKLLYIFKQPFMRPVQTTQEEDGCSCRFPEEEEGGCELRVKFS RSADAPAYQQGQNQLYNELNLGRREEYDVLDKRRGRDPEMG GKPRRKNPQEGLYNELQKDKMAEAYSEIGMKGERRRGKGHD GLYQGLSTATKDTYDALHMQALPPR |
| 628 | 4H8-R2S CD8α signal sequence, CD20 mimotope, CD20 mimotope, 4H8 ScFv, hinge and transmembrane regions of human CD8 α molecule, 41BB signaling domain, CD3ζ signaling domain | MALPVTALLLPLALLLHAARPGGGGSCPYSNPSLCGGGGSCP YSNPSLCGGGGSQVQLQQSGPGLVKPSQTLSLTCAISGDSVSS NSATWNWIRQSPSRGLEWLGRTYYRSKWYDDYAVSVKSRITI NPDTSKNHLSLHLNSVTPEDTAVYYCAGGGLVGAPDGFDVW GQGTMVTVSSGGGGSGGGGSGGGGSGGGGSQSVLTQPPSAS GTPGQRVTISCSGSSSNIGSDPVNWYQQLPGTAPKLLIYSNNQR PSGVPDRFSGSKSGTSASLAISGLQSEDEADYYCSAWDDSLNG YVFGTGTKVTVLTTTPAPRPPTPAPTIASQPLSLRPEACRPAAG GAVHTRGLDFACDIYIWAPLAGTCGVLLLSLVITKRGRKKLLY IFKQPFMRPVQTTQEEDGCSCRFPEEEEGGCELRVKFSRSADA PAYQQGQNQLYNELNLGRREEYDVLDKRRGRDPEMGGKPRR KNPQEGLYNELQKDKMAEAYSEIGMKGERRRGKGHDGLYQG LSTATKDTYDALHMQALPPR |
| 474 | 10G1K-QR3 CD8α signal sequence, CD20 mimotope, 10G1-K ScFv, CD20 mimotope, QBEND-10 epitope, CD20 mimotope, hinge and transmembrane regions of human CD8 α molecule, 41BB signaling domain, CD3ζ signaling domain | MALPVTALLLPLALLLHAARPGGGGSCPYSNPSLCSGGGGSG GGGSEVQLLESGGGLVQPGGSLRLSCAASGFTFSSYAMNWVR QAPGKGLEWVSTISGSGGSTYYADSVKGRFTISRDNSKNTLYL QMNSLRAEDTAVFYCAIDPEYYDILTGGDYWGQGTLVTVSSG GGGSGGGGSGGGGSGGGGSDIQMTQSPSAMSASVGDRVTIT CRASQGISNYLAWFQQKPGKVPKRLIYAASSLQSGVPSRFSGS GSGTEFTLTISSLQPEDFATYFCLQHDSFPLTFGGGTKVEIKGS GGGGSCPYSNPSLCSGGGGSELPTQGTFSNVSTNVSPAKPTTT ACPYSNPSLCTTTPAPRPPTPAPTIASQPLSLRPEACRPAAGGA VHTRGLDFACDIYIWAPLAGTCGVLLLSLVITKRGRKKLLYIF KQPFMRPVQTTQEEDGCSCRFPEEEEGGCELRVKFSRSADAPA YQQGQNQLYNELNLGRREEYDVLDKRRGRDPEMGGKPRRKN PQEGLYNELQKDKMAEAYSEIGMKGERRRGKGHDGLYQGLS TATKDTYDALHMQALPPR |

TABLE 9-continued

CAR and safety switch amino acid sequences

| SEQ ID NO | Name / Component | Sequence |
|---|---|---|
| 475 | 10G1-K-SR2<br>CD8α signal sequence, 10G1-K ScFv, CD20 mimotope, CD20 mimotope, hinge and transmembrane regions of human CD8 α molecule, 41BB signaling domain, CD3ζ signaling domain | MALPVTALLLPLALLLHAARPEVQLLESGGGLVQPGGSLRLSC<br>AASGFTFSSYAMNWVRQAPGKGLEWVSTISGSGGSTYYADSV<br>KGRFTISRDNSKNTLYLQMNSLRAEDTAVFYCAIDPEYYDILT<br>GGDYWGQGTLVTVSSGGGGSGGGGSGGGGSGGGGSDIQMT<br>QSPSAMSASVGDRVTITCRASQGISNYLAWFQQKPGKVPKRLI<br>YAASSLQSGVPSRFSGSGSGTEFTLTISSLQPEDFATYFCLQHD<br>SFPLTFGGGTKVEIKGSGGGGSCPYSNPSLCSGGGGSCPYSNPS<br>LCSGGGGSTTTACPYSNPSLCTTTPAPRPPTPAPTIASQPLSLRP<br>EACRPAAGGAVHTRGLDFACDIYIWAPLAGTCGVLLLSLVITK<br>RGRKKLLYIFKQPFMRPVQTTQEEDGCSCRFPEEEEGGCELRV<br>KFSRSADAPAYQQGQNQLYNELNLGRREEYDVLDKRRGRDP<br>EMGGKPRRKNPQEGLYNELQKDKMAEAYSEIGMKGERRRGK<br>GHDGLYQGLSTATKDTYDALHMQALPPR |
| 476 | 10G1-K RSR<br>CD8α signal sequence, CD20 mimotope, 10G1-K ScFv, CD20 mimotope, hinge and transmembrane regions of human CD8 α molecule, 41BB signaling domain, CD3ζ signaling domain | MALPVTALLLPLALLLHAARPGGGGSCPYSNPSLCGGGGSEV<br>QLLESGGGLVQPGGSLRLSCAASGFTFSSYAMNWVRQAPGKG<br>LEWVSTISGSGGSTYYADSVKGRFTISRDNSKNTLYLQMNSLR<br>AEDTAVFYCAIDPEYYDILTGGDYWGQGTLVTVSSGGGGSG<br>GGSGGGGSGGGGSDIQMTQSPSAMSASVGDRVTITCRASQG<br>ISNYLAWFQQKPGKVPKRLIYAASSLQSGVPSRFSGSGSGTEFT<br>LTISSLQPEDFATYFCLQHDSFPLTFGGGTKVEIKGGGGSCPYS<br>NPSLCGGGGSTTTPAPRPPTPAPTIASQPLSLRPEACRPAAGGA<br>VHTRGLDFACDIYIWAPLAGTCGVLLLSLVITKRGRKKLLYIF<br>KQPFMRPVQTTQEEDGCSCRFPEEEEGGCELRVKFSRSADAPA<br>YQQGQNQLYNELNLGRREEYDVLDKRRGRDPEMGGKPRRKN<br>PQEGLYNELQKDKMAEAYSEIGMKGERRRGKGHDGLYQGLS<br>TATKDTYDALHMQALPPR |
| 565 | 10G1-K-R2S<br>CD8α signal sequence, CD20 mimotope, CD20 mimotope, 10G1-K ScFv, hinge and transmembrane regions of human CD8 α molecule, 41BB signaling domain, CD3ζ signaling domain | MALPVTALLLPLALLLHAARPGGGGSCPYSNPSLCGGGGSCP<br>YSNPSLCGGGGSEVQLLESGGGLVQPGGSLRLSCAASGFTFSS<br>YAMNWVRQAPGKGLEWVSTISGSGGSTYYADSVKGRFTISRD<br>NSKNTLYLQMNSLRAEDTAVFYCAIDPEYYDILTGGDYWGQG<br>TLVTVSSGGGGSGGGGSGGGGSGGGGSDIQMTQSPSAMSAS<br>VGDRVTITCRASQGISNYLAWFQQKPGKVPKRLIYAASSLQSG<br>VPSRFSGSGSGTEFTLTISSLQPEDFATYFCLQHDSFPLTFGGGT<br>KVEIKTTTPAPRPPTPAPTIASQPLSLRPEACRPAAGGAVHTRG<br>LDFACDIYIWAPLAGTCGVLLLSLVITKRGRKKLLYIFKQPFM<br>RPVQTTQEEDGCSCRFPEEEEGGCELRVKFSRSADAPAYQQG<br>QNQLYNELNLGRREEYDVLDKRRGRDPEMGGKPRRKNPQEG<br>LYNELQKDKMAEAYSEIGMKGERRRGKGHDGLYQGLSTATK<br>DTYDALHMQALPPR |
| 684 | 2G1-QR3<br>CD8α signal sequence, CD20 mimotope, 2G1 ScFv, CD20 mimotope, QBEND-10 epitope, CD20 mimotope, hinge and transmembrane regions of human CD8 α molecule, 41BB signaling domain, CD3ζ signaling domain | MALPVTALLLPLALLLHAARPGGGGSCPYSNPSLCGGGGSG<br>GGGSQLQLQESGPGLVKPSETLSLTCTVSGGSISSSSYYWGWI<br>RQPPGKGLEWIGSIYYSGNIYHNPSLKSRVSISVDTSKNQFSLR<br>LSSVTAADTAVYYCAREIIVGATHFDYWGQGTLVTVSSGGGG<br>SGGGGSGGGGSGGGGSAIQMTQSPSSLSASVGDRVTITCRASQ<br>GIRNDLGWYQQKPGKAPELLIYAASSLQSGVPSRFSGSGSGTD<br>FTLTISSLQPEDFATYYCLQDYNYPLTFGPGTKVDIKGSGGGS<br>CPYSNPSLCSGGGGSELPTQGTFSNVSTNVSPAKPTTTACPYSN<br>PSLCTTTPAPRPPTPAPTIASQPLSLRPEACRPAAGGAVHTRGL<br>DFACDIYIWAPLAGTCGVLLLSLVITLYCKRGRKKLLYIFKQPF<br>MRPVQTTQEEDGCSCRFPEEEEGGCELRVKFSRSADAPAYQQ<br>GQNQLYNELNLGRREEYDVLDKRRGRDPEMGGKPRRKNPQE<br>GLYNELQKDKMAEAYSEIGMKGERRRGKGHDGLYQGLSTAT<br>KDTYDALHMQALPPR |
| 685 | 2G1-SR2<br>CD8α signal sequence, 2G1 ScFv, CD20 mimotope, CD20 mimotope, hinge and transmembrane | MALPVTALLLPLALLLHAARPQLQLQESGPGLVKPSETLSLTC<br>TVSGGSISSSSYYWGWIRQPPGKGLEWIGSIYYSGNIYHNPSLK<br>SRVSISVDTSKNQFSLRLSSVTAADTAVYYCAREIIVGATHFDY<br>WGQGTLVTVSSGGGGSGGGGSGGGGSGGGGSAIQMTQSPSSL<br>SASVGDRVTITCRASQGIRNDLGWYQQKPGKAPELLIYAASSL<br>QSGVPSRFSGSGSGTDFTLTISSLQPEDFATYYCLQDYNYPLTF<br>GPGTKVDIKGSGGGGSCPYSNPSLCSGGGGSCPYSNPSLCSGG |

TABLE 9-continued

CAR and safety switch amino acid sequences

| SEQ ID NO | Name / Component | Sequence |
|---|---|---|
| | regions of human CD8 α molecule, 41BB signaling domain, CD3ζ signaling domain | GGSTTTACPYSNPSLCTTTPAPRPPTPAPTIASQPLSLRPEACRP AAGGAVHTRGLDFACDIYIWAPLAGTCGVLLLSLVITLYCKR GRKKLLYIFKQPFMRPVQTTQEEDGCSCRFPEEEEGGCELRVK FSRSADAPAYQQGQNQLYNELNLGRREEYDVLDKRRGRDPE MGGKPRRKNPQEGLYNELQKDKMAEAYSEIGMKGERRRGKG HDGLYQGLSTATKDTYDALHMQALPPR |
| 686 | 2G1-RSR CD8α signal sequence, CD20 mimotope, 2G1 ScFv, CD20 mimotope, hinge and transmembrane regions of human CD8 α molecule, 41BB signaling domain, CD3ζ signaling domain | MALPVTALLLPLALLLHAARPGGGGSCPYSNPSLCGGGGSQL QLQESGPGLVKPSETLSLTCTVSGGSISSSSYYWGWIRQPPGKG LEWIGSIYYSGNIYHNPSLKSRVSISVDTSKNQFSLRLSSVTAA DTAVYYCAREIIVGATHFDYWGQGTLVTVSSGGGGSGGGGSG GGGSGGGGSAIQMTQSPSSLSASVGDRVTITCRASQGIRNDLG WYQQKPGKAPELLIYAASSLQSGVPSRFSGSGSGTDFTLTISSL QPEDFATYYCLQDYNYPLTFGPGTKVDIKGGGGSCPYSNPSLC GGGGSTTTPAPRPPTPAPTIASQPLSLRPEACRPAAGGAVHTRG LDFACDIYIWAPLAGTCGVLLLSLVITLYCKRGRKKLLYIFKQP FMRPVQTTQEEDGCSCRFPEEEEGGCELRVKFSRSADAPAYQ QGQNQLYNELNLGRREEYDVLDKRRGRDPEMGGKPRRKNPQ EGLYNELQKDKMAEAYSEIGMKGERRRGKGHDGLYQGLSTA TKDTYDALHMQALPPR |
| 687 | 2G1-R2S CD8α signal sequence, CD20 mimotope, CD20 mimotope, 2G1 ScFv, hinge and transmembrane regions of human CD 8α molecule, 41BB signaling domain, CD3ζ signaling domain | MALPVTALLLPLALLLHAARPGGGGSCPYSNPSLCGGGGSCP YSNPSLCGGGGSQLQLQESGPGLVKPSETLSLTCTVSGGSISSS SYYWGWIRQPPGKGLEWIGSIYYSGNIYHNPSLKSRVSISVDTS KNQFSLRLSSVTAADTAVYYCAREIIVGATHFDYWGQGTLVT VSSGGGGSGGGGSGGGGSGGGGSAIQMTQSPSSLSASVGDRV TITCRASQGIRNDLGWYQQKPGKAPELLIYAASSLQSGVPSRFS GSGSGTDFTLTISSLQPEDFATYYCLQDYNYPLTFGPGTKVDIK TTTPAPRPPTPAPTIASQPLSLRPEACRPAAGGAVHTRGLDFAC DIYIWAPLAGTCGVLLLSLVITLYCKRGRKKLLYIFKQPFMRP VQTTQEEDGCSCRFPEEEEGGCELRVKFSRSADAPAYQQGQN QLYNELNLGRREEYDVLDKRRGRDPEMGGKPRRKNPQEGLY NELQKDKMAEAYSEIGMKGERRRGKGHDGLYQGLSTATKDT YDALHMQALPPR |
| 688 | 4H8-SR2 CD8α signal sequence, 4H8 ScFv, CD20 mimotope, CD20 mimotope, hinge and transmembrane regions of human CD 8α molecule, 41BB signaling domain, CD3ζ signaling domain | MALPVTALLLPLALLLHAARPQVQLQQSGPGLVKPSQTLSLTC AISGDSVSSNSATWNWIRQSPSRGLEWLGRTYYRSKWYDDYA VSVKSRITINPDTSKNHLSLHLNSVTPEDTAVYYCAGGGLVGA PDGFDVWGQGTMVTVSSGGGGSGGGGSGGGGSGGGGSQSVL TQPPSASGTPGQRVTISCSGSSSNIGSDPVNWYQQLPGTAPKLL IYSNNQRPSGVPDRFSGSKSGTSASLAISGLQSEDEADYYCSA WDDSLNGYVFGTGTKVTVLGSGGGGSCPYSNPSLCSGGGGSC PYSNPSLCSGGGGSTTTACPYSNPSLCTTTPAPRPPTPAPTIASQ PLSLRPEACRPAAGGAVHTRGLDFACDIYIWAPLAGTCGVLLL SLVITLYCKRGRKKLLYIFKQPFMRPVQTTQEEDGCSCRFPEEE EGGCELRVKFSRSADAPAYQQGQNQLYNELNLGRREEYDVL DKRRGRDPEMGGKPRRKNPQEGLYNELQKDKMAEAYSEIGM KGERRRGKGHDGLYQGLSTATKDTYDALHMQALPPR |
| 689 | 4H8-RSR CD8α signal sequence, CD20 mimotope, 4H8 ScFv, CD20 mimotope, hinge and transmembrane regions of human CD8 α molecule, 41BB signaling domain, CD3ζ signaling domain | MALPVTALLLPLALLLHAARPGGGGSCPYSNPSLCGGGGSQV QLQQSGPGLVKPSQTLSLTCAISGDSVSSNSATWNWIRQSPSR GLEWLGRTYYRSKWYDDYAVSVKSRITINPDTSKNHLSLHLN SVTPEDTAVYYCAGGGLVGAPDGFDVWGQGTMVTVSSGGG GSGGGGSGGGGSGGGGSQSVLTQPPSASGTPGQRVTISCSGSS SNIGSDPVNWYQQLPGTAPKLLIYSNNQRPSGVPDRFSGSKSG TSASLAISGLQSEDEADYYCSAWDDSLNGYVFGTGTKVTVLG GGGSCPYSNPSLCGGGGSTTTPAPRPPTPAPTIASQPLSLRPEAC RPAAGGAVHTRGLDFACDIYIWAPLAGTCGVLLLSLVITLYCK RGRKKLLYIFKQPFMRPVQTTQEEDGCSCRFPEEEEGGCELRV KFSRSADAPAYQQGQNQLYNELNLGRREEYDVLDKRRGRDP EMGGKPRRKNPQEGLYNELQKDKMAEAYSEIGMKGERRRGK GHDGLYQGLSTATKDTYDALHMQALPPR |
| 690 | 4H8-R2S CD8α signal sequence, CD20 mimotope, CD20 mimotope, 4H8 ScFv, hinge and transmembrane regions of human CD8 α molecule, | MALPVTALLLPLALLLHAARPGGGGSCPYSNPSLCGGGGSCP YSNPSLCGGGGSQVQLQQSGPGLVKPSQTLSLTCAISGDSVSS NSATWNWIRQSPSRGLEWLGRTYYRSKWYDDYAVSVKSRITI NPDTSKNHLSLHLNSVTPEDTAVYYCAGGGLVGAPDGFDVW GQGTMVTVSSGGGGSGGGGSGGGGSGGGGSQSVLTQPPSAS GTPGQRVTISCSGSSSNIGSDPVNWYQQLPGTAPKLLIYSNNQR PSGVPDRFSGSKSGTSASLAISGLQSEDEADYYCSAWDDSLNG YVFGTGTKVTVLTTTPAPRPPTPAPTIASQPLSLRPEACRPAAG GAVHTRGLDFACDIYIWAPLAGTCGVLLLSLVITLYCKRGRKK |

TABLE 9-continued

CAR and safety switch amino acid sequences

| SEQ ID NO | Name / Component | Sequence |
|---|---|---|
| | 41BB signaling domain, CD3ζ signaling domain | LLYIFKQPFMRPVQTTQEEDGCSCRFPEEEEGGCELRVKFSRSA DAPAYQQGQNQLYNELNLGRREEYDVLDKRRGRDPEMGGKP RRKNPQEGLYNELQKDKMAEAYSEIGMKGERRRGKGHDGLY QGLSTATKDTYDALHMQALPPR |
| 691 | 10G1K-QR3 CD8α signal sequence, CD20 mimotope, 10G1-K ScFv, CD20 mimotope, QBEND-10 epitope, CD20 mimotope, hinge and transmembrane regions of human CD8 α molecule, 41BB signaling domain, CD3ζ signaling domain | MALPVTALLLLPLALLLHAARPGGGGSCPYSNPSLCSGGGGSG GGGSEVQLLESGGGLVQPGGSLRLSCAASGFTFSSYAMNWVR QAPGKGLEWVSTISGSGGSTYYADSVKGRFTISRDNSKNTLYL QMNSLRAEDTAVFYCAIDPEYYDILTGGDYWGQGTLVTVSSG GGGSGGGGSGGGGSGGGGSDIQMTQSPSAMSASVGDRVTITC RASQGISNYLAWFQQKPGKVPKRLIYAASSLQSGVPSRFSGSG SGTEFTLTISSLQPEDFATYFCLQHDSFPLTFGGGTKVEIKGSG GGGSCPYSNPSLCSGGGGSELPTQGTFSNVSTNVSPAKPTTTA CPYSNPSLCTTTPAPRPPTPAPTIASQPLSLRPEACRPAAGGAV HTRGLDFACDIYIWAPLAGTCGVLLLSLVITLYCKRGRKKLLY IFKQPFMRPVQTTQEEDGCSCRFPEEEEGGCELRVKFSRSADA PAYQQGQNQLYNELNLGRREEYDVLDKRRGRDPEMGGKPRR KNPQEGLYNELQKDKMAEAYSEIGMKGERRRGKGHDGLYQG LSTATKDTYDALHMQALPPR |
| 692 | 10G1-K-SR2 CD8α signal sequence, 10G1-K ScFv, CD20 mimotope, CD20 mimotope, hinge and transmembrane regions of human CD8 α molecule, 41BB signaling domain, CD3ζ signaling domain | MALPVTALLLLPLALLLHAARPEVQLLESGGGLVQPGGSLRLSC AASGFTFSSYAMNWVRQAPGKGLEWVSTISGSGGSTYYADSV KGRFTISRDNSKNTLYLQMNSLRAEDTAVFYCAIDPEYYDILT GGDYWGQGTLVTVSSGGGGSGGGGSGGGGSGGGGSDIQMTQ SPSAMSASVGDRVTITCRASQGISNYLAWFQQKPGKVPKRLIY AASSLQSGVPSRFSGSGSGTEFTLTISSLQPEDFATYFCLQHDSF PLTFGGGTKVEIKGSGGGGSCPYSNPSLCSGGGGSCPYSNPSLC SGGGGSTTTACPYSNPSLCTTTPAPRPPTPAPTIASQPLSLRPEA CRPAAGGAVHTRGLDFACDIYIWAPLAGTCGVLLLSLVITLYC KRGRKKLLYIFKQPFMRPVQTTQEEDGCSCRFPEEEEGGCELR VKFSRSADAPAYQQGQNQLYNELNLGRREEYDVLDKRRGRD PEMGGKPRRKNPQEGLYNELQKDKMAEAYSEIGMKGERRRG KGHDGLYQGLSTATKDTYDALHMQALPPR |
| 693 | 10G1-K RSR CD8α signal sequence, CD20 mimotope, 10G1-K ScFv, CD20 mimotope, hinge and transmembrane regions of human CD8 α molecule, 41BB signaling domain, CD3ζ signaling domain | MALPVTALLLLPLALLLHAARPGGGGSCPYSNPSLCGGGGSEV QLLESGGGLVQPGGSLRLSCAASGFTFSSYAMNWVRQAPGKG LEWVSTISGSGGSTYYADSVKGRFTISRDNSKNTLYLQMNSLR AEDTAVFYCAIDPEYYDILTGGDYWGQGTLVTVSSGGGGSGG GGSGGGGSGGGGSDIQMTQSPSAMSASVGDRVTITCRASQGIS NYLAWFQQKPGKVPKRLIYAASSLQSGVPSRFSGSGSGTEFTL TISSLQPEDFATYFCLQHDSFPLTFGGGTKVEIKGGGGSCPYSN PSLCGGGGSTTTPAPRPPTPAPTIASQPLSLRPEACRPAAGGAV HTRGLDFACDIYIWAPLAGTCGVLLLSLVITLYCKRGRKKLLY IFKQPFMRPVQTTQEEDGCSCRFPEEEEGGCELRVKFSRSADA PAYQQGQNQLYNELNLGRREEYDVLDKRRGRDPEMGGKPRR KNPQEGLYNELQKDKMAEAYSEIGMKGERRRGKGHDGLYQG LSTATKDTYDALHMQALPPR |
| 694 | 10G1-K-R2S CD8α signal sequence, CD20 mimotope, CD20 mimotope, 10G1-K ScFv, hinge and transmembrane regions of human CD8 α molecule, 41BB signaling domain, CD3ζ signaling domain | MALPVTALLLLPLALLLHAARPGGGGSCPYSNPSLCGGGGSCP YSNPSLCGGGGSEVQLLESGGGLVQPGGSLRLSCAASGFTFSS YAMNWVRQAPGKGLEWVSTISGSGGSTYYADSVKGRFTISRD NSKNTLYLQMNSLRAEDTAVFYCAIDPEYYDILTGGDYWGQG TLVTVSSGGGGSGGGGSGGGGSGGGGSDIQMTQSPSAMSASV GDRVTITCRASQGISNYLAWFQQKPGKVPKRLIYAASSLQSGV PSRFSGSGSGTEFTLTISSLQPEDFATYFCLQHDSFPLTFGGGTK VEIKTTTPAPRPPTPAPTIASQPLSLRPEACRPAAGGAVHTRGL DFACDIYIWAPLAGTCGVLLLSLVITLYCKRGRKKLLYIFKQPF MRPVQTTQEEDGCSCRFPEEEEGGCELRVKFSRSADAPAYQQ GQNQLYNELNLGRREEYDVLDKRRGRDPEMGGKPRRKNPQE GLYNELQKDKMAEAYSEIGMKGERRRGKGHDGLYQGLSTAT KDTYDALHMQALPPR |

Figure 9A:
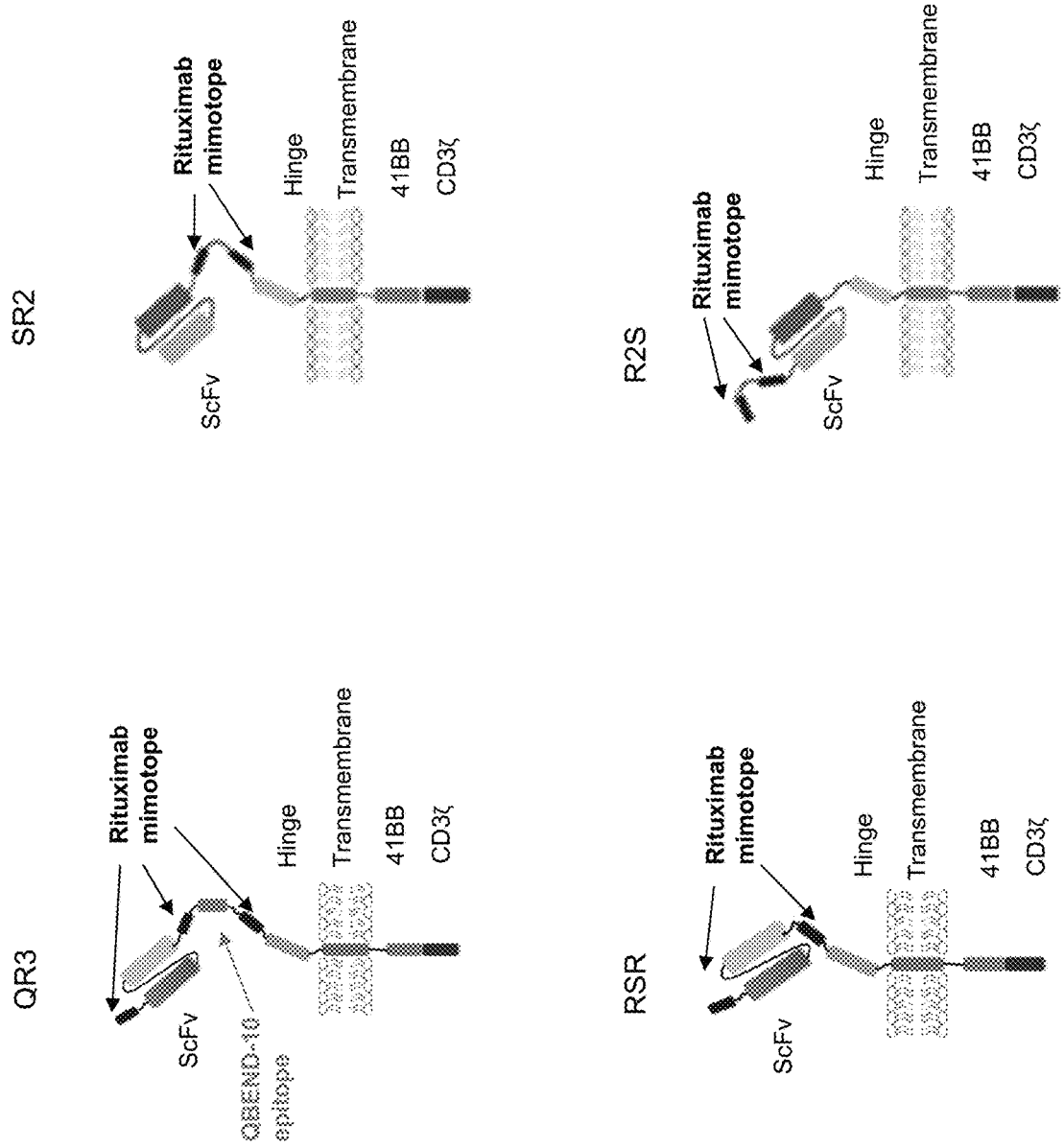
FIGS. 9A-9C depict the structure, transduction efficiency of primary T-cells and the cytotoxic activity of anti-DLL3 CARs with safety switch.
Figure 9B:
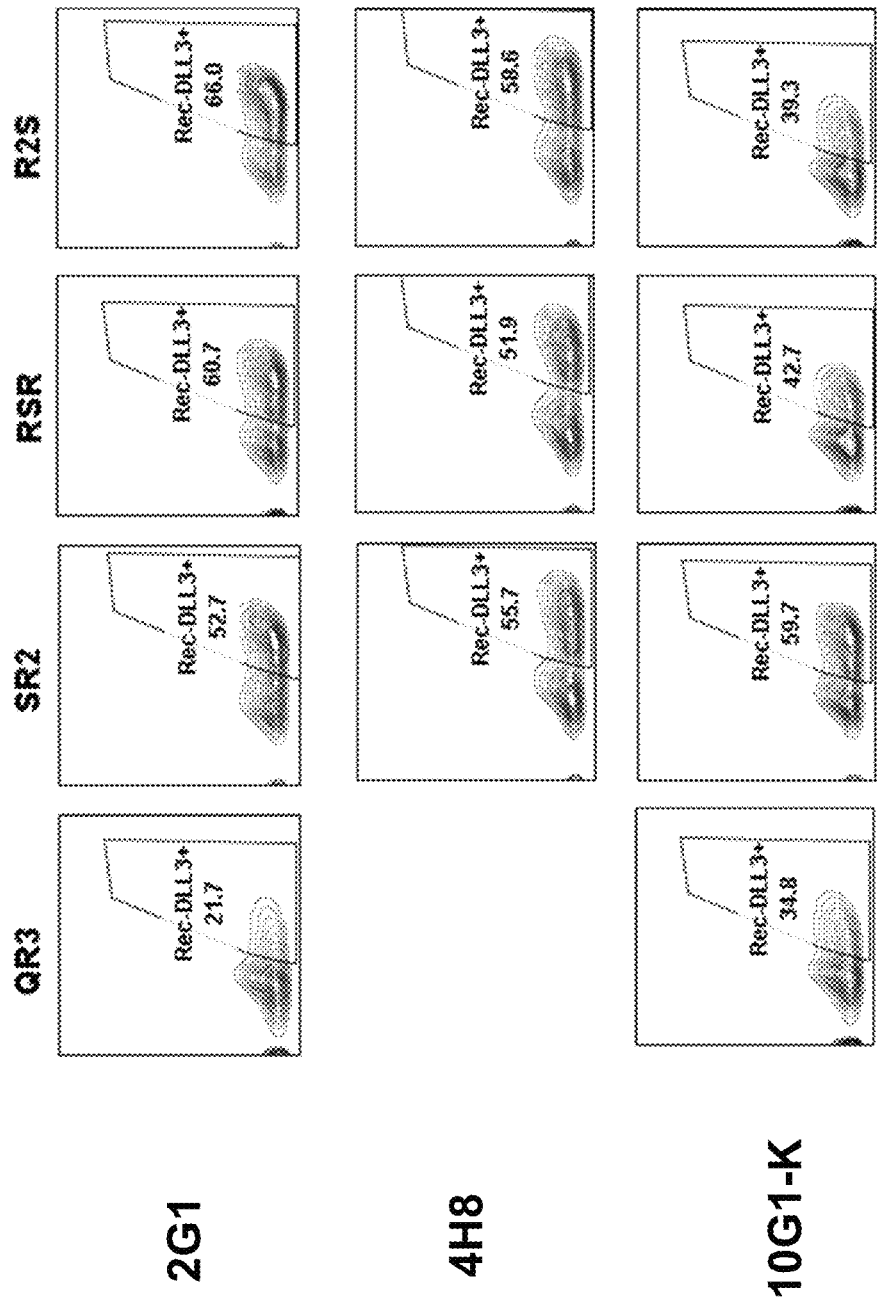
Figure 9C:
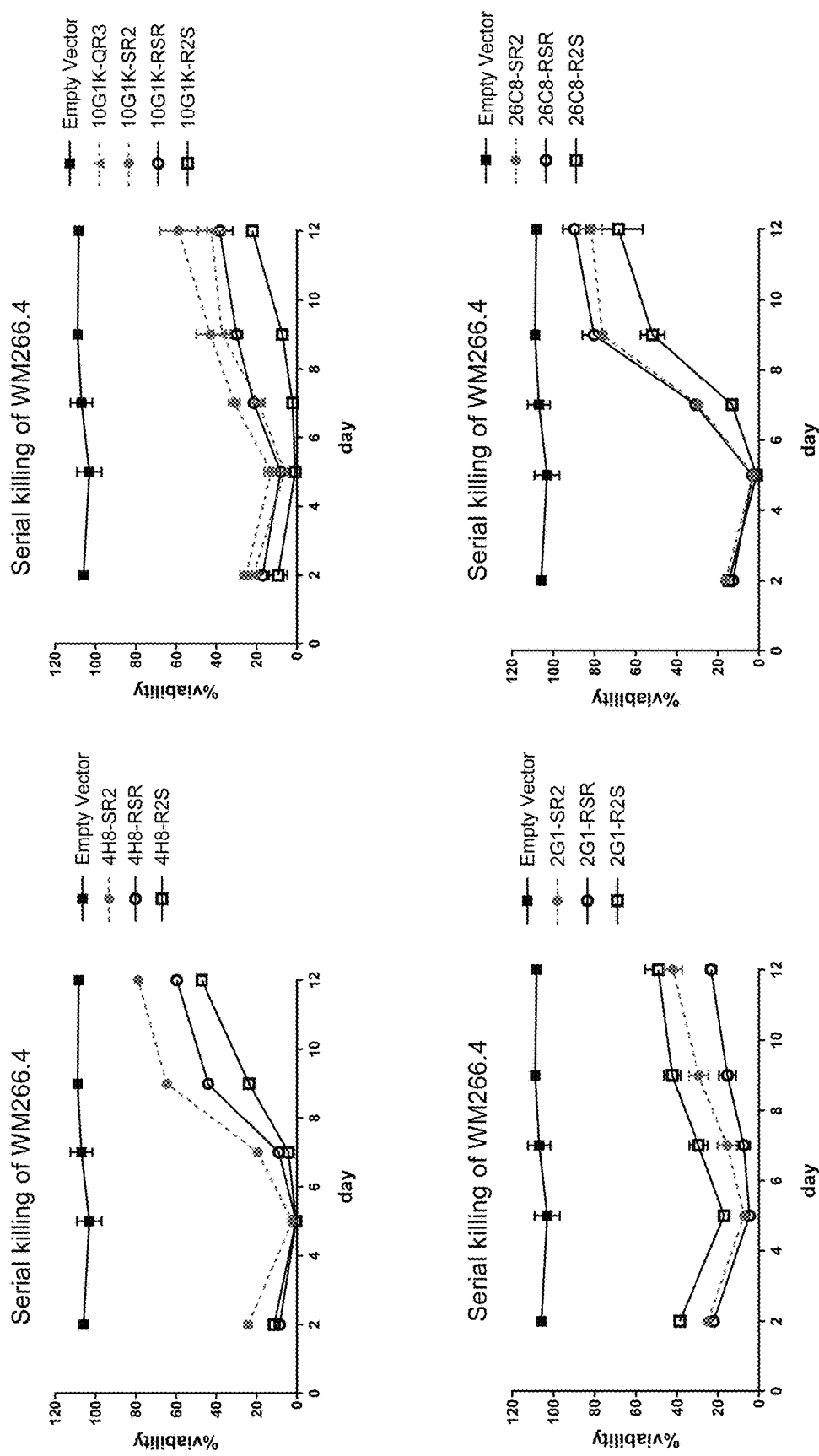

CAR-Ts were generated using methods described in Example 5 and their cytotoxic activity were examined using methods described in Example 7. FIG. 9A are plots showing the structure of four different safety switches. FIG. 9B depicts experimental flow cytometry data showing that anti-DLL3 CARs 2G1, 4H8 and 10G1-K with safety switches are expressed on the surface of primary T-cells and can recognize recombinant DLL3. The plots are gated on live CD3+ cells and the numbers on the plots are the percentage of cells expressing each anti-DLL3 CAR. FIG. 9C depicts experimental data showing that anti-DLL3 CARs with safety switches are active in serial killing assay of DLL3+WM266.4 cell line.

Example 10: Cytotoxicity Against Small Cell Lung Cancer PDX Models

Small cell lung cancer PDX models were purchased from Crown Bioscience. To examine DLL3 expression of cell surface, frozen vials of PDX models were thawed and 200,000 cells were used for each staining sample. The expression of DLL3 was verified in a FACS assay using PE conjugated anti-DLL3 antibody. Brilliant violet 421 conjugated anti-human CD45 and anti-mouse CD45 antibodies were added in the same staining sample to exclude human and mouse lymphocytes.

Figure 10B:
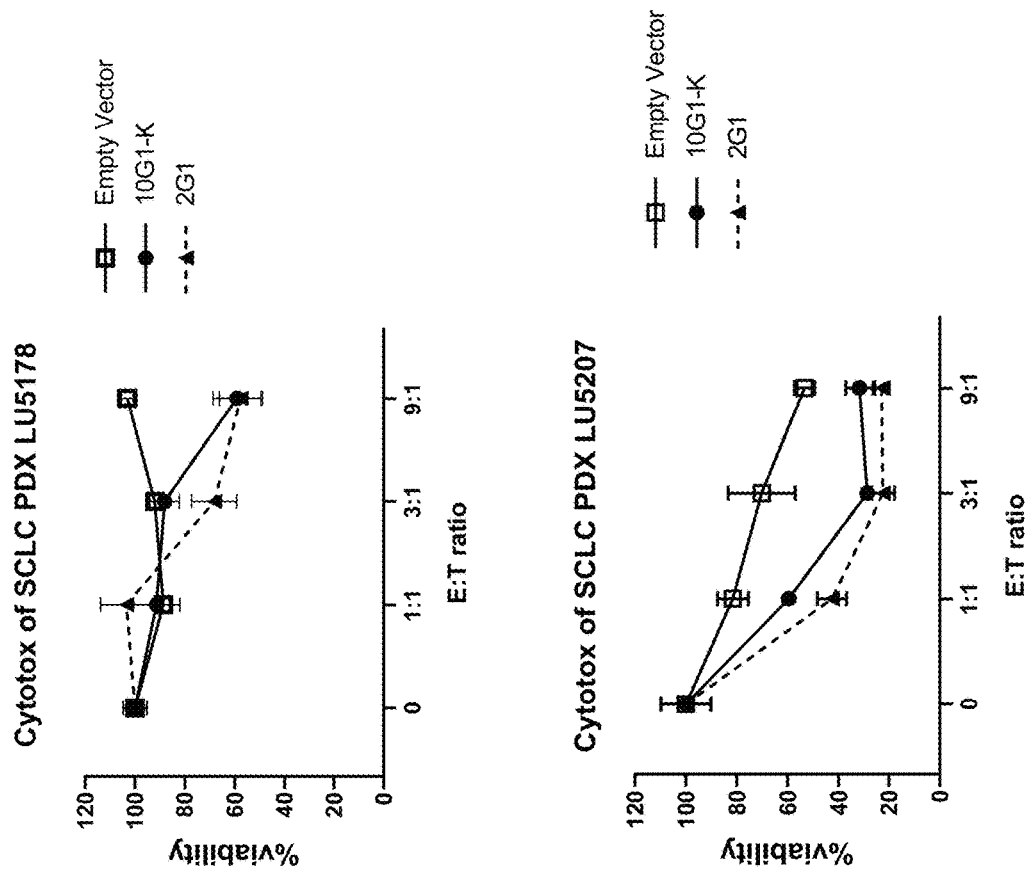
FIG. 10B shows experimental data showing anti-DLL3 CAR-Ts show cytotoxic activity against the same two PDX models.
Figure 10A:
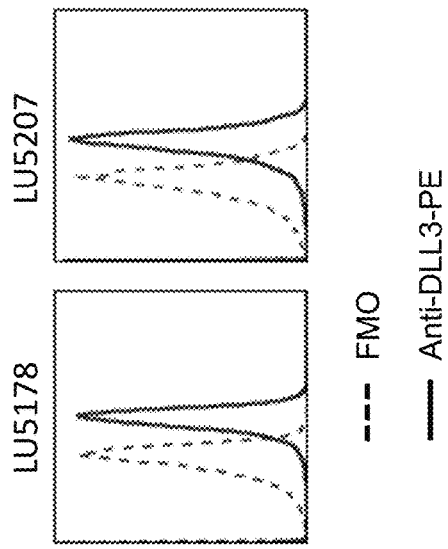
FIG. 10A depicts plots showing that two small cell lung cancer patient-derived xenograft (PDX) models express DLL3 on cell surface. Solid line and dashed line represent staining with anti-DLL3 antibodies or fluorescence minus one (FMO), respectively.

FIG. 10A depicts experimental data showing DLL3 is expressed on the surface of two small cell lung cancer PDX models. FIG. 10B shows experimental data showing anti-DLL3 CAR-T cells killed the same two small cell lung PDX models in a 3-day cytotoxicity assay at indicated effector: target ratios. T cells that didn't express anti-DLL3 CARs (labelled empty vector) were used as negative control.

Figure 11A:
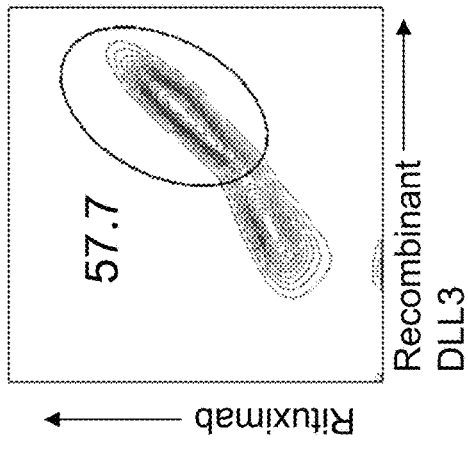
FIGS. 11A-11B show safety switches allow detection and depletion of DLL3 CAR-T cells with rituximab.
Figure 11A:
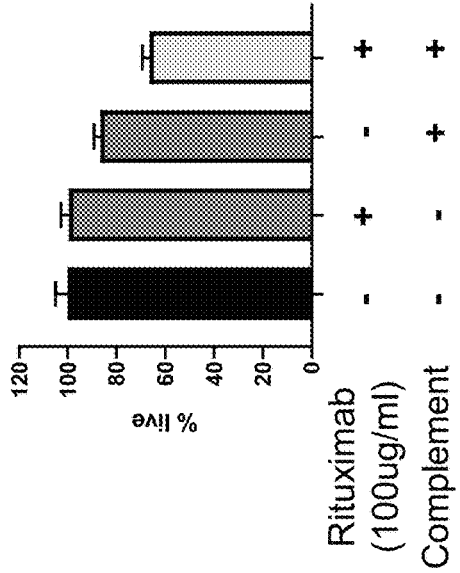
Figure 11B:
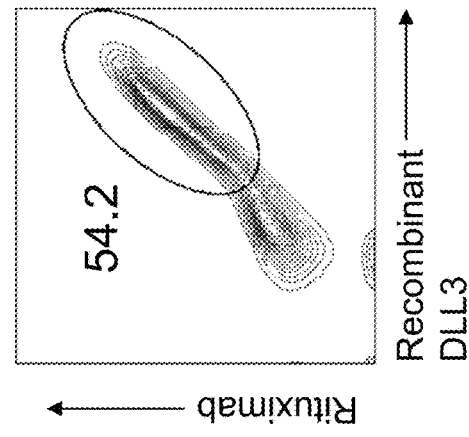
Figure 11B:
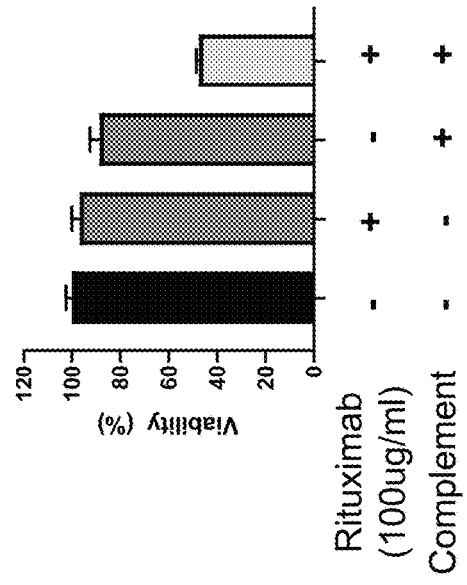

Example 11: In Vitro Detection and Depletion of DLL3 CAR-T Cells Using Rituximab-Based Safety-Switch In order to deplete or turn off CAR T cells in the event of unwanted activity, a rituximab off-switch was developed by insertion of rituximab mimotopes at varying location in the extracellular region of the CARs as described in Example 9. Complement-dependent cytotoxicity assay was used to evaluate rituximab-dependent in vitro depletion of DLL3 CAR-T cells. In this assay, frozen CAR-T cells were thawed and $1 \times 10^5$ cells were incubated in RPMI 1640 medium supplemented with 10% FBS in 96-well plates. Cells were incubated for 3 hours in the absence or presence of 25% baby rabbit complement (Cedarlane, CL3441-S) and rituximab antibodies (produced in-house; 100 mg/mL). Cells were stained with recombinant DLL3 (Adipogen) and cytotoxicity was analyzed by flow cytometry. FIG. 11A depicts experimental data showing anti-DLL3 CAR-T cells can be detected by both recombinant DLL3 and rituximab staining FIG. 11B depicts experimental data showing DLL3 CAR-T cells were depleted in vitro in a rituximab-dependent and complement-dependent manner.

Example 12: In Vivo Activity of Anti-DLL3 CAR-T Cells with a Safety Switch

Figure 12A:
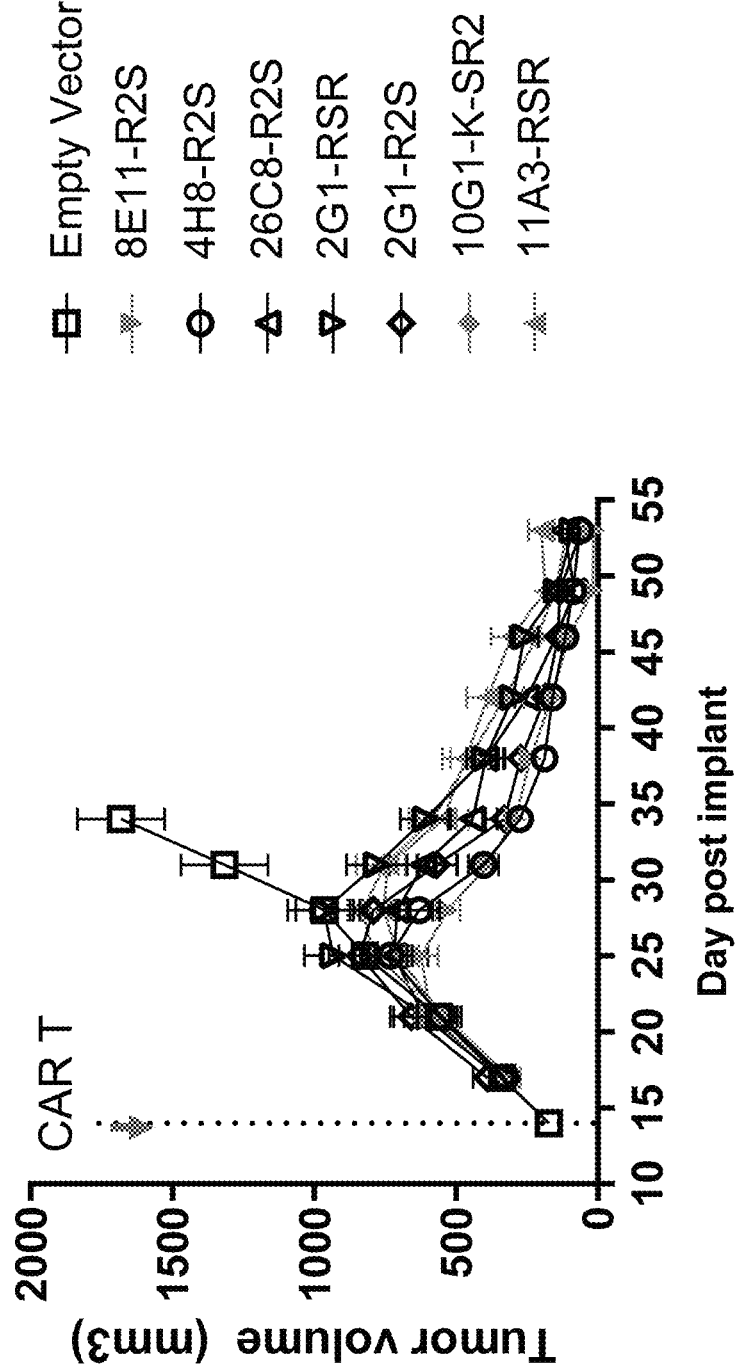
FIGS. 12A-12B depict plots demonstrating that anti-DLL3 CAR-T cells with safety switches inhibited the growth of subcutaneous or IV injected small cell lung cancer tumors.

To test the anti-tumor activity of DLL3 CAR-T cells with a safety switch, SHP-77 tumor bearing NSG mice were used. SHP-77 cells were thawed from a frozen vial, counted and diluted. $50 \times 10^6$ viable cells/mL in RPMI medium/matrigel suspension was injected per mouse subcutaneously. Tumor growth was monitored by caliper measurements using a digital caliper starting from Day 5 post-implantation. Tumor size was calculated using the formula Tumor volume=(width^2×length/2). Mice were randomized into groups of 8 based on tumor volume about 14 days post-implantation. Average tumor volume per group was 178 mm$^3$. On the same day after mice were randomized, Non-transduced T cells and DLL3 CAR-T cells were thawed and counted according to standard procedure. Cells were resuspended in RPMI at $5 \times 10^6$ CAR+ cells/mouse by tail vein IV injection in a volume of 200 uL/mouse. Tumors continued to be monitored every 3-4 days until the end of the study. All groups of DLL3 CAR-T cells with safety switch induced significant tumor inhibition and complete or near complete elimination of detectable tumor by Day 50 (FIG. 12A).

Figure 12B:
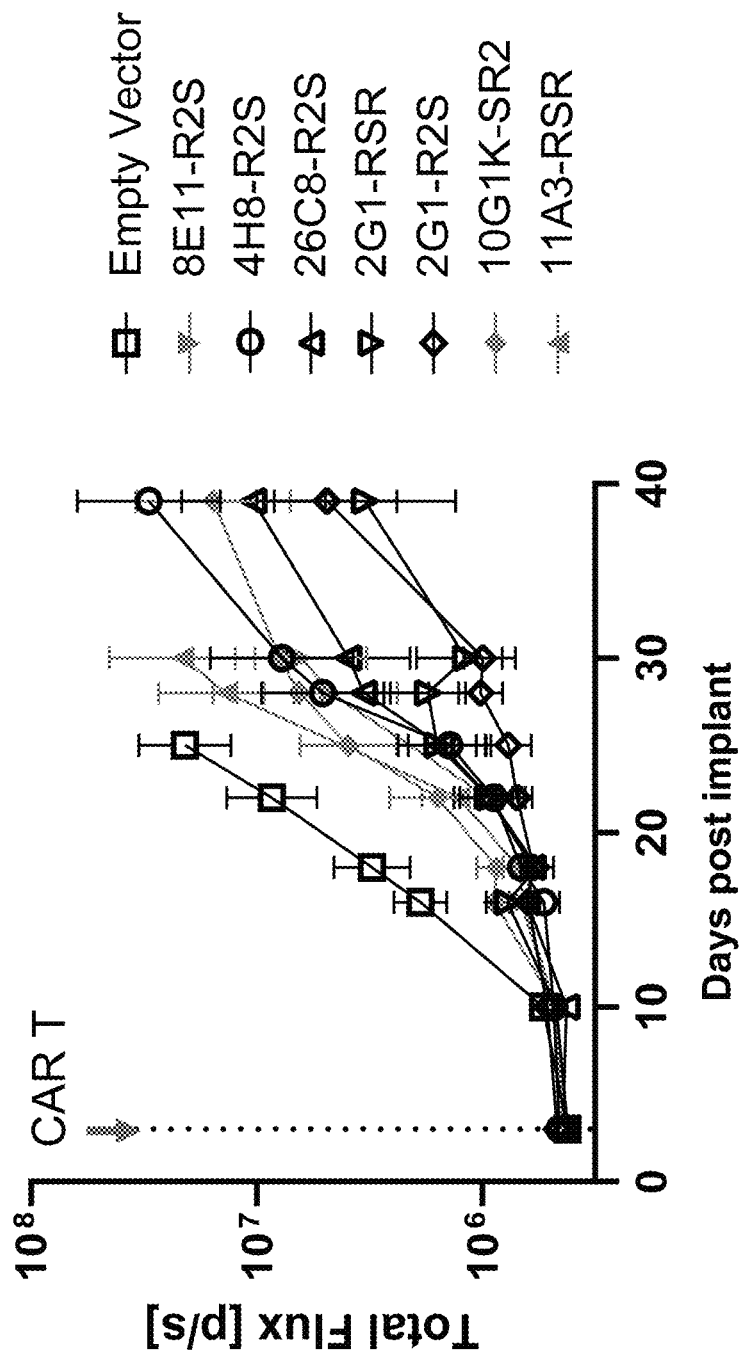

To test anti-tumor activity of DLL3 CAR-T cells in models that show metastasis like human disease, DMS 273 small cell lung tumors expressing exogenous DLL3 (DMS 273-DLL3) were established with tail vein injection. Specifically, DMS 273-DLL3 cells were thawed and diluted to $5 \times 10^5$ viable cells/mL in RPMI medium. 200 uL of cell suspension was injected per mouse by tail vein IV. On day 3 post-implantation, mice were randomized into groups of 9. On the same day, DLL3 CAR-Ts were thawed, counted and resuspended in RPMI medium at $5 \times 10^6$ CAR+ cells per mouse by tail vein IV injection in a volume of 200 uL per mouse. Tumors continued to be monitored every 3-4 days using IVIS imaging system until the end of the study. As shown in FIG. 12B, multiple different DLL3 CARs with different rituximab-based safety switches were effective against metastatic tumors.

Example 13: Mouse Safety Study Using Non-Tumor Bearing Animals

Figure 13A:
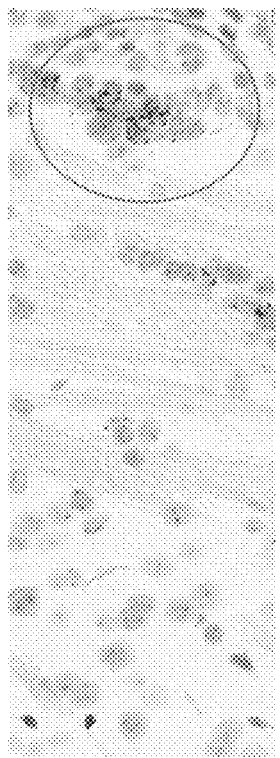
FIG. 13A shows a representative image of mouse DLL3 RNA expression in the brain of NSG mice. Circle indicates clusters of mouse DLL3 RNA.

DLL3 RNA has been reported in human brain and pituitary (GTex). Similarly, mouse DLL3 RNA has also been reported in pituitary (Bio-GPS). To understand DLL3 RNA expression in mouse brain, brains from three NSG mice were fixed in 10% neutral buffered formalin (NBF), embedded, serially sectioned at 4-6 microns, and analyzed in an RNAscope®LS Red ISH assay (ACDBio). DLL3 RNA was detected at low levels in brain samples of NSG mice. FIG. 13A shows a representative image of the mouse DLL3 RNA staining observed in this assay.

Figure 13B:
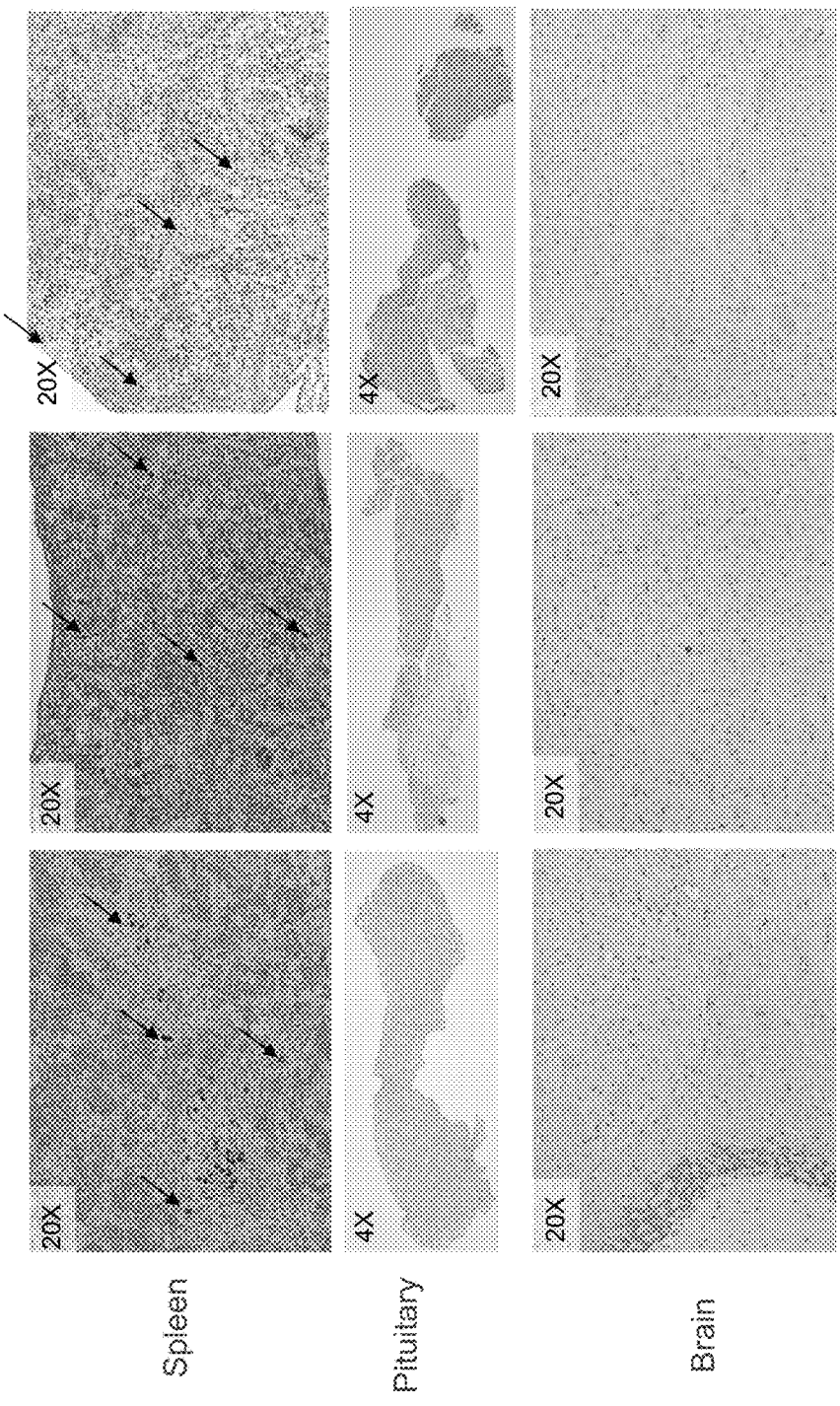
FIG. 13B shows anti-human CD3 staining of spleen, pituitary and brain samples of animals dosed with non-transduced T cells, 10G1-K DLL3 CAR-T cells or 2G1 DLL3 CAR-T cells. Arrows indicate CD3 positive cells in spleens.

To understand the potential toxicity liabilities of DLL3 RNA expression in the brain and pituitary, non-transduced T cells, $8 \times 10^6$ 10 G1-K DLL3 CAR-T cells, or $8 \times 10^6$ 2 G1 DLL3 CAR-T cells were IV injected into NSG mice. Seven days after injection, spleens, brains and pituitaries were harvested, fixed in 10% NBF, embedded, serially sectioned at 4-6 microns, and stained with anti-human CD3 antibody (Abcam, ab52959, 1:500 dilution) to detect human T cells by immunohistochemistry. Although T cells were detected in spleens from all animals, they were not detected in brain or pituitary samples (FIG. 13B). Thus, although DLL3 RNA was detected at a low level in non-tumor bearing NSG mice, DLL3 CAR-T cells were not detected in the brain or pituitary samples of the mice.

Example 14: Mouse Safety Study Using Animals Bearing Subcutaneous Tumor

Figure 14A:
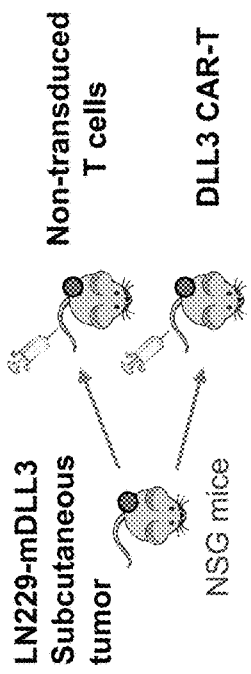
Figure 14B:
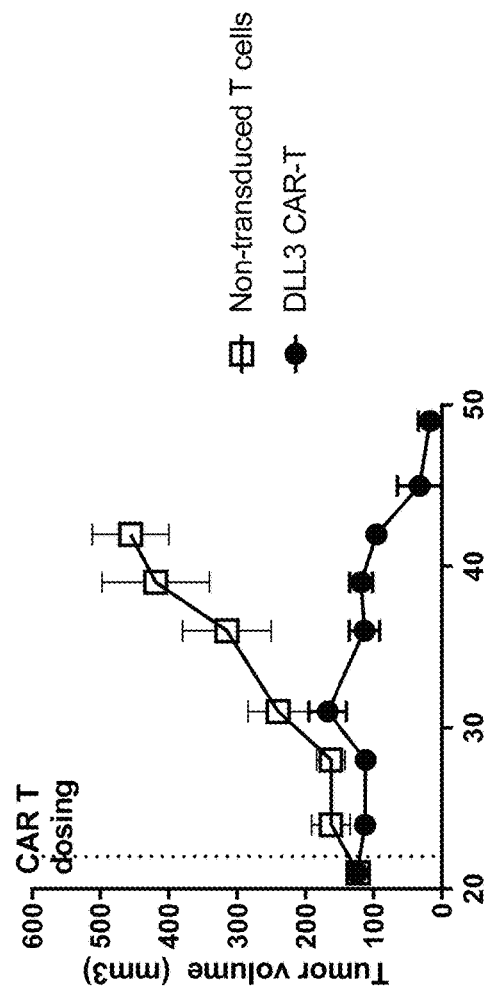

To further evaluate potential brain and pituitary toxicity liabilities, DLL3 CAR-T cells were injected into NSG mice bearing subcutaneous LN229 tumors that express exogenous mouse DLL3 (LN229-mDLL3). In this model, activation of CAR-T by tumor cells may lead to increased sensitivity and activity against potential DLL3-expressing normal tissues. The experiment design is shown in FIG. 14A. Three days before tumor implantation (day −3), adeno-associated viruses (AAV) encoding IL-7 & IL-15 (Vigene Biosciences) were injected through tail vein to support CAR-T cell expansion and persistence. LN229-mDLL3 cells were then thawed from a frozen vial and diluted to $4.25 \times 10^7$ cells/mL in complete growth medium (RPMI+10% FBS). Cell suspension was kept on ice until implantation. Immediately before implanting, cells were mixed 1:1 with BD Matrigel Matrix (cat #354234) and 200 µL of cells/matrigel suspension containing $4.25 \times 10^6$ LN229-mDLL3 cells was injected per mouse subcutaneously. Tumor growth was monitored by caliper measurements using a digital caliper starting from Day 8 post-implantation. Tumor size was calculated using the formula Tumor volume=(width^2×length/2). On day 22 post implantation, mice were randomized into groups of 5 based on tumor volume and serum concentration of IL-7 and IL-15. On the same day (day 22), non-transduced T cells and mouse cross-reactive 10G1-K DLL3 CAR-T cells were thawed and resuspended in RPMI+10% FBS and injected at $1\times10^7$ CAR+ cells/mouse by tail vein IV injection in a volume of 200 uL/mouse. Tumors continued to be monitored every 3-4 days until the end of the study and robust anti-tumor activity with DLL3 CAR T treatment was observed (FIG. 14B).

On day 49, when animals that received DLL3 CAR-T cells were tumor free, brain tissues from animals were fixed in 10% NBF and embedded to reveal the ventricular system, including the lateral, third and fourth ventricles, such that the three sections were placed into a single block that was serially sectioned at 4-6 microns, and stained with hematoxylin and eosin (H&E) or stained to detect human-specific CD3 (hCD3) by immunohistochemistry. Pituitary glands were fixed in 10% NBF, processed and stained with H&E or immunohistochemically stained to demonstrate hCD3. The H&E slides were examined microscopically and histopathologic findings were scored by a pathologist using a standard system. Administration of DLL3 CAR-T cells resulted in abundant hCD3-staining T cells in the pituitary pars intermedia and nervosa with relatively few T cells in the pars distalis (FIG. 14C and data not shown). Sparse-to-moderately low or moderate-to-moderately high hCD3 staining of T cells was present in brain neuropil and vasculature (as circulating T cells) (FIG. 14C and data not shown). No other pituitary or brain findings were present (FIGS. 14C-D). To understand the functional consequences of T cell infiltration, two hormones released in the pars nervosa, vasopressin and oxytocin, were stained using immunohistochemistry. For vasopressin detection, samples were stained with anti-vasopressin antibody (ImmunoStar, 20069) at 1/7,000 dilution for 1 hour at room temperature and then with Rabbit-on-Rodent HRP-Polymer (Biocare Medical) for 30 minutes at room temperature. For oxytocin detection, samples were stained with anti-oxytocin antibody (ImmunoStar, 20068) at 1/10,000 dilution for 15 minutes at room temperature and then with Rabbit-on-Rodent HRP-Polymer (Biocare Medical) for 30 minutes at room temperature. Both hormones can be detected in the pituitary pars nervosa of animals that received non-transduced T cells or DLL3 CAR-T cells, suggesting that hormone producing neurons in this region remained functional (FIGS. 14E-F). Thus, no tissue damage was seen in the samples based on the pathological evaluation and hormone staining.

Example 15: Mouse Safety Study Using Animals Bearing Intracranial Tumors

To promote T cell infiltration into the brain and further understand potential brain toxicity, NSG mice bearing intracranial LN229 tumors that express exogenous mouse DLL3 and human EGFRvIII (LN229-mDLL3-vIII) were used. The experiment design is shown in FIG. 15A. LN229-mDLL3 cells were thawed from a frozen vial and diluted to $1\times10^7$ viable cells/mL in RPMI. Then 3 μL of cell suspension containing $3\times10^4$ LN229-mDLL3 cells was injected per mouse intracranially. Tumor growth was monitored by IVIS imaging system. On day 17 post implantation, mice were randomized into groups of 10 based on tumor volume. On the same day (day 17), TCR knocked-out, non-transduced T cells, 10G1-K DLL3 CAR-T cells, and EGFRvIII CAR-T cells were thawed and resuspended in RPMI and injected at $1\times10^7$ CAR+ cells/mouse by tail vein IV injection in a volume of 200 uL/mouse. EGFRvIII CAR-T cells were included as control to evaluate potential inflammation caused by tumor lysis in the brain. In order to support CAR-T cell expansion and persistence, 0.5 ug IL-15 (Peprotech AF-200-15) and 3 ug IL-15Ra Fc fusion protein (R&D Systems 7194-IR) were given to each animal twice weekly starting on day 17 until the end of the study. Tumors continued to be monitored every 3-4 days until the end of the study and clear anti-tumor activity was observed (FIG. 15B). On day 22 and 38, brain tissues from all animals were trimmed, processed, and embedded to reveal the ventricular system, including the lateral, third and fourth ventricles, such that the three sections were placed into a single block that was serially sectioned at 4-6 microns, and stained with H&E or stained to detect human-specific CD45 (hCD45) by immunohistochemistry. Pituitary gland tissues were processed to include pars nervosa, intermedia, and distalis, and stained with H&E or immunohistochemically stained to detect hCD45 as the marker for human T cells.

On day 22, animals that received non-transduced T cells or 10G1-K DLL3 CAR-T cells had rare/sparse hCD45 staining T cells in the brain or pituitary gland (data not shown). On the other hand, for animals treated with EGFRvIII CAR-T cells, hCD45+ staining ranged from rare/sparse to moderately low or moderate-to-moderately high in areas of infiltrate/gliosis or glioma, consistent with anti-tumor activity in this group (data not shown). On day 38, animals that received non-transduced T cells or EGFRvIII CAR-T cells had rare/sparse hCD45+ staining in the brain and pituitary gland. Animals that received 10G1-K DLL3 CAR-T cells had minimal or mild mononuclear cell infiltrate in the pituitary gland, primarily in the pars intermedia and nervosa (FIGS. 15C-D). Also, these animals had slightly more (moderately low) hCD45+ staining associated with the small foci of glioma compared with the rare/sparse staining in other areas of the brain (vasculature of the brain, choroid plexus, and meninges), consistent with anti-tumor activity in this group as shown in FIG. 15B.

Example 16: In Vitro Cytotoxicity of Disassociated Mouse Pituitary Cells

To directly test whether the DLL3 CARTs are active against the pituitary, mouse pituitaries from NSG mice were harvested under aseptic conditions for in vitro analysis. Tissues were dissociated by 3 rounds of incubations at 37 C in 1 mL dissociation mix [5 mL DMEM, high glucose, GlutaMax (Gibco, cat #10564), 50 uL Enzyme H, 5 uL Enzyme R, 6.25 uL Enzyme A (Miltenyi tumor dissociation kit #130-095-929)] followed by mechanical dissociation using trituration. Single cells were transferred to complete medium (DMEM, high glucose, GlutaMax, 20%, 1× Insulin-Transferrin-Selenium Solution, 1×MEM Non-Essential Amino Acids, 1× Penicillin-Streptomycin) and pooled following each round. Cells were pelleted and treated with ACK lysis buffer for 3 min at RT, followed by neutralization in complete medium. The cell suspension was filtered through a 70u filter and centrifuged to remove buffer. Cells were counted and plated in 96-well plate in complete medium at $5\times10^4$ cells per well and let to recover for 3 days before CAR-T cells were added. At the time CAR-T cells are added, the expected target density is $1\times10^4$ cells per well. For controls, DLL3+ cells (DMS-273) and DLL3− cells (293T) were plated at the same densities. 10G1-K and 2G1 DLL3 CAR-T cells were added at E:T=9:1, 3:1, and 1:1 and co-cultured with targets for 3 days. At the end of 3 day co-culture, the media was separated from the wells and centrifuged to pellet out the T cells. The target cells were treated with 50 uL/well Cell Titer Glo (Promega, G7570) for 10 minutes and analyzed in SpectraMax plate reader for cytotox readout.

Figures 16A, 16B:
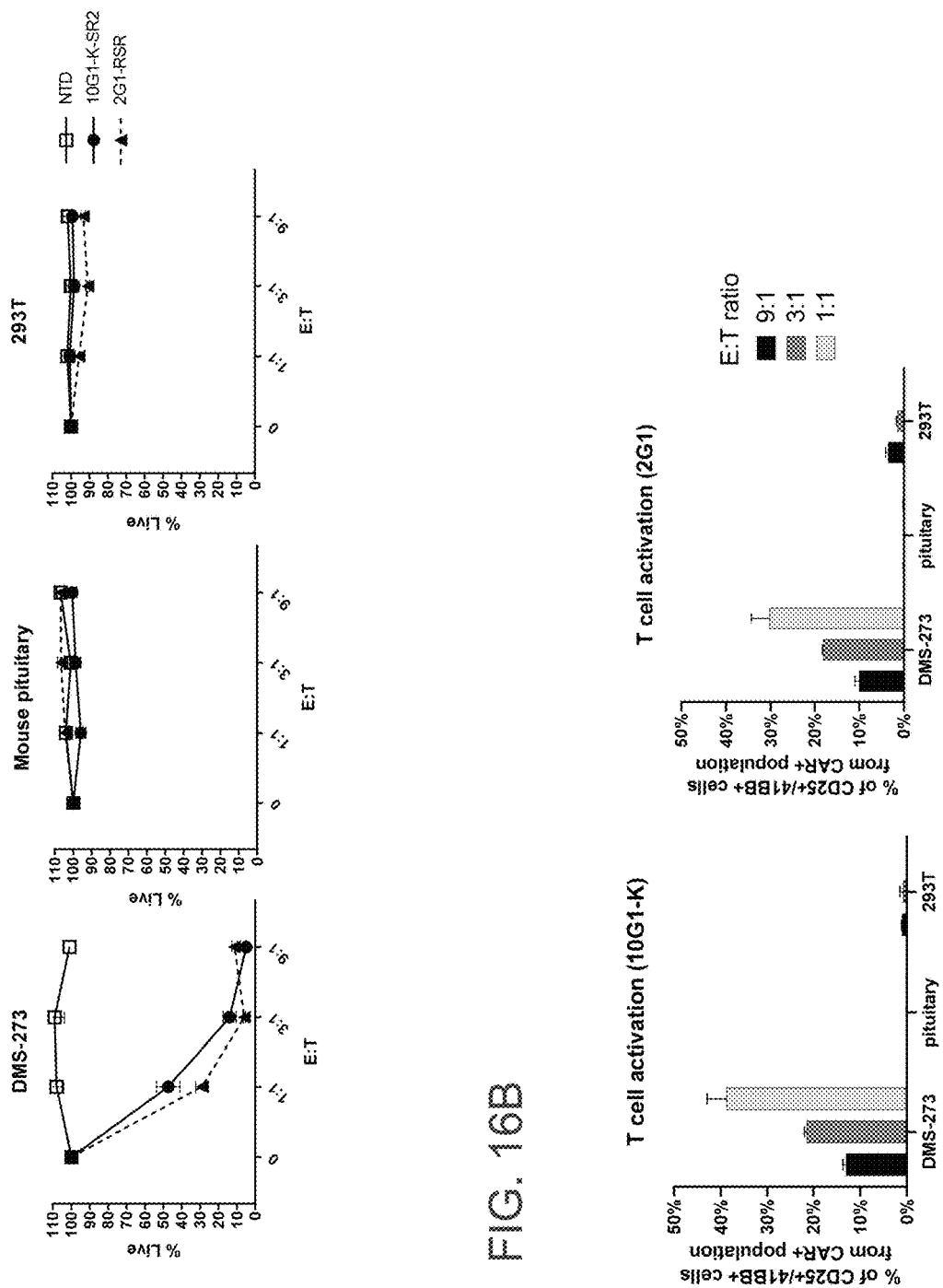

FIG. 16A depicts experimental data showing that although DLL3 CAR-T cells are active against DLL3+ DMS 273 cell line, they are not cytotoxic against mouse pituitary cells in vitro. The T cells were pooled and stained for activation markers (41BB and CD25) for analysis by flow cytometry. FIG. 16B depicts that mouse pituitary cells do not activate DLL3 CAR-T cells in vitro. The supernatant was frozen at −80C and then thawed for cytokine analysis using Human TH1/TH2 10-Plex Tissue Culture Kit (Meso Scale Discovery, K15010B). FIG. 16C depicts that although both 10G1-K and 2G1 DLL3 CAR-T cells secrete interferon-gamma (IFNγ), tumor necrosis factor alpha (TNF-α), and IL-2 when co-cultured with DLL3+ DMS 273 cell line, there is no cytokine secretion after co-culturing DLL3 CAR-T cells with mouse pituitary cells. Thus, DLL3 CAR-T cells were not cytotoxic against pituitary cells in vitro.

SEQUENCE LISTING (696 sequences)

SEQ ID NO: 1 - protein, 9 aa, Artificial Sequence
  Description of Artificial Sequence: Synthetic peptide
NSISNYYWS

SEQ ID NO: 2 - protein, 12 aa, Artificial Sequence
  Description of Artificial Sequence: Synthetic peptide
AYIYYSGTTNYN

SEQ ID NO: 3 - protein, 14 aa, Artificial Sequence
  Description of Artificial Sequence: Synthetic peptide
CARLFNWGFAFDIW

SEQ ID NO: 4 - protein, 11 aa, Artificial Sequence
  Description of Artificial Sequence: Synthetic peptide
RASQSVSSNLA

SEQ ID NO: 5 - protein, 7 aa, Artificial Sequence
  Description of Artificial Sequence: Synthetic peptide
GASTRAT

SEQ ID NO: 6 - protein, 11 aa, Artificial Sequence [sequence omitted]

SEQ ID NO: 7 - protein, 118 aa, Artificial Sequence
  Description of Artificial Sequence: Synthetic polypeptide
QVQLQESGPGLVKPSETLSLTCTVSDNSISNYYWSWIRQPPGKGLEWIAYIYYSGTTNYNPSLKSRVTISLDTSKNQFSLKLSSVTAADTAVYYCARLFNWGFAFDIWGQGTMVTVSS

SEQ ID NO: 8 - protein, 107 aa, Artificial Sequence
  Description of Artificial Sequence: Synthetic polypeptide
EIVMTQSPATLSVSPGERATLSCRASQSVSSNLAWYQQKPGQAPRLLIYGASTRATGIPARFSGSGSGTEFTLTISSLQSEDFAVYYCQQYNNWPLTFGGGTKVEIK

SEQ ID NO: 9 - protein, 245 aa, Artificial Sequence
  Description of Artificial Sequence: Synthetic polypeptide
QVQLQESGPGLVKPSETLSLTCTVSDNSISNYYWSWIRQPPGKGLEWIAYIYYSGTTNYNPSLKSRVTISLDTSKNQFSLKLSSVTAADTAVYYCARLFNWGFAFDIWGQGTMVTVSSGGGGSGGGGSGGGGSGGGGSEIVMTQSPATLSVSPGERATLSCRASQSVSSNLAWYQQKPGQAPRLLIYGASTRATGIPARFSGSGSGTEFTLTISSLQSEDFAVYYCQQYNNWPLTFGGGTKVEIK

SEQ ID NO: 10 - protein, 9 aa, Artificial Sequence
  Description of Artificial Sequence: Synthetic peptide
GSISSSYWS

SEQ ID NO: 11 - protein, 12 aa, Artificial Sequence
  Description of Artificial Sequence: Synthetic peptide
GYIYYSGTTNYN

SEQ ID NO: 12 - protein, 14 aa, Artificial Sequence
  Description of Artificial Sequence: Synthetic peptide
CARVAPTGFWFDYW

SEQ ID NO: 13 - protein, 12 aa, Artificial Sequence
  Description of Artificial Sequence: Synthetic peptide
RASQRVSSRYLA

SEQ ID NO: 14 - protein, 7 aa, Artificial Sequence
  Description of Artificial Sequence: Synthetic peptide
GASSRAT

SEQ ID NO: 15 - protein, 11 aa, Artificial Sequence [sequence omitted]

SEQ ID NO: 16 - protein, 118 aa, Artificial Sequence
  Description of Artificial Sequence: Synthetic polypeptide
QVQLQESGPGLMKPSETLSLTCTVSGGSISSSYWSCIRQPPGKGLEWIGYIYYSGTTNYNPSLKSRVTLSLDTSKNQFSLRLTSVTAADTAVYYCARVAPTGFWFDYWGQGTLVTVSS

SEQ ID NO: 17 - protein, 108 aa, Artificial Sequence
  Description of Artificial Sequence: Synthetic polypeptide
EIVLTQSPGTLSLSPGERATLSCRASQRVSSRYLAWYQQKPGQAPRLLIYGASSRATGIPDRFSGSGSGTDFTLTISRLEPEEFAVYYCQQYGTSPLTFGGGTKVEIK

SEQ ID NO: 18 - protein, 246 aa, Artificial Sequence
  Description of Artificial Sequence: Synthetic polypeptide
QVQLQESGPGLMKPSETLSLTCTVSGGSISSSYWSCIRQPPGKGLEWIGYIYYSGTTNYNPSLKSRVTLSLDTSKNQFSLRLTSVTAADTAVYYCARVAPTGFWFDYWGQGTLVTVSSGGGGSGGGGSGGGGSGGGGSEIVLTQSPGTLSLSPGERATLSCRASQRVSSRYLAWYQQKPGQAPRLLIYGASSRATGIPDRFSGSGSGTDFTLTISRLEPEEFAVYYCQQYGTSPLTFGGGTKVEIK

SEQ ID NO: 19 - protein, 9 aa, Artificial Sequence
  Description of Artificial Sequence: Synthetic peptide
FTFSSHDMH

SEQ ID NO: 20 - protein, 12 aa, Artificial Sequence
  Description of Artificial Sequence: Synthetic peptide
SAIGIAGDTYYS

SEQ ID NO: 21 - protein, 14 aa, Artificial Sequence
  Description of Artificial Sequence: Synthetic peptide
CARANWGEGAFDIW

SEQ ID NO: 22 - protein, 11 aa, Artificial Sequence
  Description of Artificial Sequence: Synthetic peptide
RASQGISDYLA

SEQ ID NO: 23 - protein, 7 aa, Artificial Sequence
  Description of Artificial Sequence: Synthetic peptide
AASTLQS

SEQ ID NO: 24 - protein, 11 aa, Artificial Sequence [sequence omitted]

SEQ ID NO: 25 - protein, 118 aa, Artificial Sequence
  Description of Artificial Sequence: Synthetic polypeptide
EVQLVESGGGLVQPGGSLRLSCAASGFTFSSHDMHWVRQATGKGLEWVSAIGIAGDTYYSGSVKGRFTISRENAKNSLYLQMNSLRAGDTAVYYCARANWGEGAFDIWGQGTMVTVSS

SEQ ID NO: 26 - protein, 107 aa, Artificial Sequence
  Description of Artificial Sequence: Synthetic polypeptide
DIQMTQSPSSLSASVGDRVTITCRASQGISDYLAWYQQKPGKIPKLLIYAASTLQSGVPSRFSGSGSGTDFTLTISSLQPEDVATYYCQKYNSVPLTFGGGTKVEIK

SEQ ID NO: 27 - protein, 245 aa, Artificial Sequence
  Description of Artificial Sequence: Synthetic polypeptide
EVQLVESGGGLVQPGGSLRLSCAASGFTFSSHDMHWVRQATGKGLEWVSAIGIAGDTYYSGSVKGRFTISRENAKNSLYLQMNSLRAGDTAVYYCARANWGEGAFDIWGQGTMVTVSSGGGGSGGGGSGGGGSGGGGSDIQMTQSPSSLSASVGDRVTITCRASQGISDYLAWYQQKPGKIPKLLIYAASTLQSGVPSRFSGSGSGTDFTLTISSLQPEDVATYYCQKYNSVPLTFGGGTKVEIK

SEQ ID NO: 28 - protein, 9 aa, Artificial Sequence
  Description of Artificial Sequence: Synthetic peptide
DSISNYYWS

SEQ ID NO: 29 - protein, 9 aa, Artificial Sequence
  Description of Artificial Sequence: Synthetic peptide
DSISNYYWS

SEQ ID NO: 30 - protein, 14 aa, Artificial Sequence
  Description of Artificial Sequence: Synthetic peptide
CARVFNWGFAFDIW

SEQ ID NO: 31 - protein, 12 aa, Artificial Sequence
  Description of Artificial Sequence: Synthetic peptide
RASQRISRTYLA

SEQ ID NO: 32 - protein, 7 aa, Artificial Sequence
  Description of Artificial Sequence: Synthetic peptide
GASSRAT

SEQ ID NO: 33 - protein, 11 aa, Artificial Sequence [sequence omitted]

SEQ ID NO: 34 - protein, 118 aa, Artificial Sequence
  Description of Artificial Sequence: Synthetic polypeptide
QVQLQESGPGLVKPSETLSLTCTVSDDSISNYYWSWIRQPPGKGLEWIGYIFYSGTTNHNPSLKSRLTISLDKAKNQFSLRLSSVTAADTAVYYCARVFNWGFAFDIWGQGTMVTVSS

SEQ ID NO: 35 - protein, 108 aa, Artificial Sequence
  Description of Artificial Sequence: Synthetic polypeptide
EIVLTQSPGTLSLSPGERATLSCRASQRISRTYLAWYQQKPGQAPRLLIYGASSRATGIPDRFTGSGSGTDFTLTISRLEPEDFAVYYCQQYGTSPLTFGGGTKVEIN

SEQ ID NO: 36 - protein, 246 aa, Artificial Sequence
  Description of Artificial Sequence: Synthetic polypeptide
QVQLQESGPGLVKPSETLSLTCTVSDDSISNYYWSWIRQPPGKGLEWIGYIFYSGTTNHNPSLKSRLTISLDKAKNQFSLRLSSVTAADTAVYYCARVFNWGFAFDIWGQGTMVTVSSGGGGSGGGGSGGGGSGGGGSEIVLTQSPGTLSLSPGERATLSCRASQRISRTYLAWYQQKPGQAPRLLIYGASSRATGIPDRFTGSGSGTDFTLTISRLEPEDFAVYYCQQYGTSPLTFGGGTKVEIN

SEQ ID NO: 37 - protein, 9 aa, Artificial Sequence
  Description of Artificial Sequence: Synthetic peptide
NSISNYYWS

SEQ ID NO: 38 - protein, 12 aa, Artificial Sequence
  Description of Artificial Sequence: Synthetic peptide
AYIYYSGTTNYN

SEQ ID NO: 39 - protein, 14 aa, Artificial Sequence
  Description of Artificial Sequence: Synthetic peptide
CARVFHWGFAFDIW

SEQ ID NO: 40 - protein, 12 aa, Artificial Sequence
  Description of Artificial Sequence: Synthetic peptide
RASQRVSNTYLA

SEQ ID NO: 41 - protein, 7 aa, Artificial Sequence
  Description of Artificial Sequence: Synthetic peptide
GASSRAT

SEQ ID NO: 42 - protein, 11 aa, Artificial Sequence [sequence omitted]

SEQ ID NO: 43 - protein, 118 aa, Artificial Sequence
  Description of Artificial Sequence: Synthetic polypeptide
QVQLQESGPGLVKPSETLSLTCTVSDNSISNYYWSWIRQPPGKGLEWIAYIYYSGTTNYNPSLKSRVTISLDTSKNQFSLQLSSVTAADAAVYYCARVFHWGFAFDIWGQGTMVTVSS

SEQ ID NO: 44 - protein, 108 aa, Artificial Sequence
  Description of Artificial Sequence: Synthetic polypeptide
EIVLTQSPGTLSLSPGERATLSCRASQRVSNTYLAWYQQNPGQAPRLLIYGASSRATGIPDRFSGSGSGTDFTLTISRLEPEDFAVYYCQQYGTSPLTFGGGTKVEIK

SEQ ID NO: 45 - protein, 246 aa, Artificial Sequence
  Description of Artificial Sequence: Synthetic polypeptide
QVQLQESGPGLVKPSETLSLTCTVSDNSISNYYWSWIRQPPGKGLEWIAYIYYSGTTNYNPSLKSRVTISLDTSKNQFSLQLSSVTAADAAVYYCARVFHWGFAFDIWGQGTMVTVSSGGGGSGGGGSGGGGSGGGGSEIVLTQSPGTLSLSPGERATLSCRASQRVSNTYLAWYQQNPGQAPRLLIYGASSRATGIPDRFSGSGSGTDFTLTISRLEPEDFAVYYCQQYGTSPLTFGGGTKVEIK

SEQ ID NO: 46 - protein, 9 aa, Artificial Sequence
  Description of Artificial Sequence: Synthetic peptide
VSISSYYWS

SEQ ID NO: 47 - protein, 12 aa, Artificial Sequence
  Description of Artificial Sequence: Synthetic peptide
GYIYYSGTTNYN

SEQ ID NO: 48 - protein, 14 aa, Artificial Sequence
  Description of Artificial Sequence: Synthetic peptide
CARLSNWGFAFDIW

SEQ ID NO: 49 - protein, 12 aa, Artificial Sequence
  Description of Artificial Sequence: Synthetic peptide
RASQTISSSYLA

SEQ ID NO: 50 - protein, 7 aa, Artificial Sequence
  Description of Artificial Sequence: Synthetic peptide
GASSRAT

SEQ ID NO: 51 - protein, 11 aa, Artificial Sequence
  Description of Artificial Sequence: Synthetic peptide
CQQYGWSPITF

SEQ ID NO: 52 - protein, 118 aa, Artificial Sequence
  Description of Artificial Sequence: Synthetic polypeptide
QVQLQESGPGLVKPSETLSLTCTVSNVSISSYYWSWIRQPPGKGLEWIGYIYYSGTTNYNPSLKSRVTMSVDTSKNQFSLKLSSVTAADTAVYFCARLSNWGFAFDIWGQGTMVTFSS

SEQ ID NO: 53 - protein, 108 aa, Artificial Sequence
  Description of Artificial Sequence: Synthetic polypeptide
EIVLTQSPGTLSLSPGERATLSCRASQTISSSYLAWYQQKPGQAPRLLIYGASSRATGIPDRFSGSGSGTEFTLTISRLEPEDFAVYYCQQYGWSPITFGQGTRLEIK

SEQ ID NO: 54 - protein, 246 aa, Artificial Sequence
  Description of Artificial Sequence: Synthetic polypeptide
QVQLQESGPGLVKPSETLSLTCTVSNVSISSYYWSWIRQPPGKGLEWIGYIYYSGTTNYNPSLKSRVTMSVDTSKNQFSLKLSSVTAADTAVYFCARLSNWGFAFDIWGQGTMVTFSSGGGGSGGGGSGGGGSGGGGSEIVLTQSPGTLSLSPGERATLSCRASQTISSSYLAWYQQKPGQAPRLLIYGASSRATGIPDRFSGSGSGTEFTLTISRLEPEDFAVYYCQQYGWSPITFGQGTRLEIK

SEQ ID NO: 55 - protein, 9 aa, Artificial Sequence
  Description of Artificial Sequence: Synthetic peptide
FTFSSYDMH

SEQ ID NO: 56 - protein, 12 aa, Artificial Sequence
  Description of Artificial Sequence: Synthetic peptide
SAIGPAGDTYYP

SEQ ID NO: 57 - protein, 16 aa, Artificial Sequence
  Description of Artificial Sequence: Synthetic peptide
CARADPPYYYYGMDVW

SEQ ID NO: 58 - protein, 16 aa, Artificial Sequence
  Description of Artificial Sequence: Synthetic peptide
RSSQSLLHSNEYNYLD

SEQ ID NO: 59 - protein, 7 aa, Artificial Sequence
  Description of Artificial Sequence: Synthetic peptide
LGSNRAS

SEQ ID NO: 60 - protein, 11 aa, Artificial Sequence [sequence omitted]

SEQ ID NO: 61 - protein, 120 aa, Artificial Sequence
  Description of Artificial Sequence: Synthetic polypeptide
EVQLVESGGGLVQPGGSLRLSCAASGFTFSSYDMHWVRQATGKGLEWVSAIGPAGDTYYPGSVKGRFTISRENAKNSLYLQMNSLRAGDTAVYYCARADPPYYYYGMDVWGQGTTVTVSS

SEQ ID NO: 62 - protein, 112 aa, Artificial Sequence
  Description of Artificial Sequence: Synthetic polypeptide
DIVMTQSPLSLPVTPGEPASISCRSSQSLLHSNEYNYLDWYLQKPGQSPQLLIYLGSNRASGVPDRFSGSGSGTDFILKISRVEAEDVGVYYCMQALEIPLTFGGGTKVEIK

SEQ ID NO: 63 - protein, 252 aa, Artificial Sequence
  Description of Artificial Sequence: Synthetic polypeptide
EVQLVESGGGLVQPGGSLRLSCAASGFTFSSYDMHWVRQATGKGLEWVSAIGPAGDTYYPGSVKGRFTISRENAKNSLYLQMNSLRAGDTAVYYCARADPPYYYYGMDVWGQGTTVTVSSGGGGSGGGGSGGGGSGGGGSDIVMTQSPLSLPVTPGEPASISCRSSQSLLHSNEYNYLDWYLQKPGQSPQLLIYLGSNRASGVPDRFSGSGSGTDFILKISRVEAEDVGVYYCMQALEIPLTFGGGTKVEIK

SEQ ID NO: 64 - protein, 11 aa, Artificial Sequence
  Description of Artificial Sequence: Synthetic peptide
FSLSTRGVGVG

SEQ ID NO: 65 - protein, 12 aa, Artificial Sequence
  Description of Artificial Sequence: Synthetic peptide
ALIYWNDDKRYS

SEQ ID NO: 66 - protein, 14 aa, Artificial Sequence
  Description of Artificial Sequence: Synthetic peptide
CARSNWGNWYFALW

SEQ ID NO: 67 - protein, 11 aa, Artificial Sequence
  Description of Artificial Sequence: Synthetic peptide
RASQSVSSYLA

SEQ ID NO: 68 - protein, 7 aa, Artificial Sequence
  Description of Artificial Sequence: Synthetic peptide
DAFYRAT

SEQ ID NO: 69 - protein, 11 aa, Artificial Sequence [sequence omitted]

SEQ ID NO: 70 - protein, 120 aa, Artificial Sequence
  Description of Artificial Sequence: Synthetic polypeptide
QITLKESGPTLVKPTQTLTLTCTFSGFSLSTRGVGVGWIRQPPGKALEWLALIYWNDDKRYSPSLQTRLTITKDTPKNQVVLTMTNMDPVDTATYYCARSNWGNWYFALWGRGTLVTVSS

SEQ ID NO: 71 - protein, 107 aa, Artificial Sequence
  Description of Artificial Sequence: Synthetic polypeptide
EIVLTQSPATLSLSPGERATLSCRASQSVSSYLAWYQQKPGQAPRLLIYDAFYRATGIPARFSGSGSGTDFTLTISSLEPEDFAVYYCQHRSNWPITFGQGTRLEIK

SEQ ID NO: 72 - protein, 247 aa, Artificial Sequence
  Description of Artificial Sequence: Synthetic polypeptide
QITLKESGPTLVKPTQTLTLTCTFSGFSLSTRGVGVGWIRQPPGKALEWLALIYWNDDKRYSPSLQTRLTITKDTPKNQVVLTMTNMDPVDTATYYCARSNWGNWYFALWGRGTLVTVSSGGGGSGGGGSGGGGSGGGGSEIVLTQSPATLSLSPGERATLSCRASQSVSSYLAWYQQKPGQAPRLLIYDAFYRATGIPARFSGSGSGTDFTLTISSLEPEDFAVYYCQHRSNWPITFGQGTRLEIK

SEQ ID NO: 73 - protein, 9 aa, Artificial Sequence
  Description of Artificial Sequence: Synthetic peptide
DSISNYYWT

SEQ ID NO: 74 - protein, 12 aa, Artificial Sequence
  Description of Artificial Sequence: Synthetic peptide
GYIYYSGTTNSN

SEQ ID NO: 75 - protein, 14 aa, Artificial Sequence
  Description of Artificial Sequence: Synthetic peptide
CARVFNRGFAFDIW

SEQ ID NO: 76 - protein, 14 aa, Artificial Sequence
  Description of Artificial Sequence: Synthetic peptide
CARVFNRGFAFDIW

SEQ ID NO: 77 - protein, 7 aa, Artificial Sequence
  Description of Artificial Sequence: Synthetic peptide
GASSRAT

SEQ ID NO: 78 - protein, 11 aa, Artificial Sequence [sequence omitted]

SEQ ID NO: 79 - protein, 118 aa, Artificial Sequence
  Description of Artificial Sequence: Synthetic polypeptide
QVQLQESGPGLVKPSETLSLTCTVSGDSISNYYWTWIRQPPGKGLEWIGYIYYSGTTNSNPSLKSRVTVSLDTSKSQFSLNLSSVTAADTAVYYCARVFNRGFAFDIWGQGTMVTVSS

SEQ ID NO: 80 - protein, 108 aa, Artificial Sequence
  Description of Artificial Sequence: Synthetic polypeptide
EIVLTQSPGTLSLSPGERATLSCRASQRISNTYLAWYQQKPGQAPRLLIYGASSRATGIPDRFSGSGSGTDFTLTISRLEPEDFAAYYCQQYDTSPLTFGGGTKVEIK

SEQ ID NO: 81 - protein, 246 aa, Artificial Sequence
  Description of Artificial Sequence: Synthetic polypeptide
QVQLQESGPGLVKPSETLSLTCTVSGDSISNYYWTWIRQPPGKGLEWIGYIYYSGTTNSNPSLKSRVTVSLDTSKSQFSLNLSSVTAADTAVYYCARVFNRGFAFDIWGQGTMVTVSSGGGGSGGGGSGGGGSGGGGSEIVLTQSPGTLSLSPGERATLSCRASQRISNTYLAWYQQKPGQAPRLLIYGASSRATGIPDRFSGSGSGTDFTLTISRLEPEDFAAYYCQQYDTSPLTFGGGTKVEIK

SEQ ID NO: 82 - protein, 11 aa, Artificial Sequence
  Description of Artificial Sequence: Synthetic peptide
VSLSTSGMCVS

SEQ ID NO: 83 - protein, 12 aa, Artificial Sequence
  Description of Artificial Sequence: Synthetic peptide
GFIDWDDDKYYN

SEQ ID NO: 84 - protein, 17 aa, Artificial Sequence
  Description of Artificial Sequence: Synthetic peptide
CARIRGYSGSYDAFDIW

SEQ ID NO: 85 - protein, 16 aa, Artificial Sequence
  Description of Artificial Sequence: Synthetic peptide
RSSQSLLHSNGYNHLD

SEQ ID NO: 86 - protein, 7 aa, Artificial Sequence
  Description of Artificial Sequence: Synthetic peptide
LGSNRAS

SEQ ID NO: 87 - protein, 11 aa, Artificial Sequence [sequence omitted]

SEQ ID NO: 88 - protein, 123 aa, Artificial Sequence
  Description of Artificial Sequence: Synthetic polypeptide
QVTLRESGPALVKPTQTLTLTCTVSGVSLSTSGMCVSWIRQPLGKALEWLGFIDWDDDKYYNTSLKTRLTISKDTSKNQVVLTMTNMDPVDTATYYCARIRGYSGSYDAFDIWGQGTVVIVSS

SEQ ID NO: 89 - protein, 112 aa, Artificial Sequence
  Description of Artificial Sequence: Synthetic polypeptide
DIVMTQSPLSLPVTPGEPASISCRSSQSLLHSNGYNHLDWYLQKPGQSPQVLIYLGSNRASGVPDRFSGSGSGTDFTLKISRVEAEDVGVYFCMQALQTPLTFGGGTKVEIK

SEQ ID NO: 90 - protein, 255 aa, Artificial Sequence
  Description of Artificial Sequence: Synthetic polypeptide
QVTLRESGPALVKPTQTLTLTCTVSGVSLSTSGMCVSWIRQPLGKALEWLGFIDWDDDKYYNTSLKTRLTISKDTSKNQVVLTMTNMDPVDTATYYCARIRGYSGSYDAFDIWGQGTVVIVSSGGGGSGGGGSGGGGSGGGGSDIVMTQSPLSLPVTPGEPASISCRSSQSLLHSNGYNHLDWYLQKPGQSPQVLIYLGSNRASGVPDRFSGSGSGTDFTLKISRVEAEDVGVYFCMQALQTPLTFGGGTKVEIK

SEQ ID NO: 91 - protein, 9 aa, Artificial Sequence
  Description of Artificial Sequence: Synthetic peptide
GSISSYYWS

SEQ ID NO: 92 - protein, 12 aa, Artificial Sequence
  Description of Artificial Sequence: Synthetic peptide
GYMYYSGTTNYN

SEQ ID NO: 93 - protein, 14 aa, Artificial Sequence
  Description of Artificial Sequence: Synthetic peptide
CARVGLTGFFFDYW

SEQ ID NO: 94 - protein, 11 aa, Artificial Sequence
  Description of Artificial Sequence: Synthetic peptide
RASQGIRNDLG

SEQ ID NO: 95 - protein, 7 aa, Artificial Sequence
  Description of Artificial Sequence: Synthetic peptide
AASSLQS

SEQ ID NO: 96 - protein, 11 aa, Artificial Sequence [sequence omitted]

SEQ ID NO: 97 - protein, 118 aa, Artificial Sequence
  Description of Artificial Sequence: Synthetic polypeptide
QVQLQVSGPGLVKPSETLSLTCSVSGGSISSYYWSWIRQSPGKGLDWIGYMYYSGTTNYNPSLKSRVTISVDTSKNQFSLKLSSVTATDTAVYYCARVGLTGFFFDYWGQGTLVTVSS

SEQ ID NO: 98 - protein, 107 aa, Artificial Sequence
  Description of Artificial Sequence: Synthetic polypeptide
AIQMTQSPSSLSASVGDRVTITCRASQGIRNDLGWYQQKPGKAPKLLIYAASSLQSGVPSRFSGSGSGTDFTLTVSSLQPEDFATYYCLQDYNYPYTFGQGTKLEIK

SEQ ID NO: 99 - protein, 245 aa, Artificial Sequence
  Description of Artificial Sequence: Synthetic polypeptide
QVQLQVSGPGLVKPSETLSLTCSVSGGSISSYYWSWIRQSPGKGLDWIGYMYYSGTTNYNPSLKSRVTISVDTSKNQFSLKLSSVTATDTAVYYCARVGLTGFFFDYWGQGTLVTVSSGGGGSGGGGSGGGGSGGGGSAIQMTQSPSSLSASVGDRVTITCRASQGIRNDLGWYQQKPGKAPKLLIYAASSLQSGVPSRFSGSGSGTDFTLTVSSLQPEDFATYYCLQDYNYPYTFGQGTKLEIK

SEQ ID NO: 100 - protein, 9 aa, Artificial Sequence
  Description of Artificial Sequence: Synthetic peptide
GSSSGNYWS

SEQ ID NO: 101 - protein, 12 aa, Artificial Sequence
  Description of Artificial Sequence: Synthetic peptide
GEINHSGTTSYN

SEQ ID NO: 102 - protein, 12 aa, Artificial Sequence
  Description of Artificial Sequence: Synthetic peptide
CARGELGIADSW

SEQ ID NO: 103 - protein, 11 aa, Artificial Sequence
  Description of Artificial Sequence: Synthetic peptide
RASQSISRWLA

SEQ ID NO: 104 - protein, 7 aa, Artificial Sequence
  Description of Artificial Sequence: Synthetic peptide
KASSLES

SEQ ID NO: 105 - protein, 10 aa, Artificial Sequence [sequence omitted]

SEQ ID NO: 106 - protein, 116 aa, Artificial Sequence
  Description of Artificial Sequence: Synthetic polypeptide
QVQLQQWGGGLLKPSETLSLTCAVYGGSSSGNYWSWIRQPPGKRLEWIGEINHSGTTSYNPSLKSRVTISVDTSKNQFSLKLSSVTAADTAVYYCARGELGIADSWGQGTLVTVSS

SEQ ID NO: 107 - protein, 106 aa, Artificial Sequence
  Description of Artificial Sequence: Synthetic polypeptide
DIQMTQSPSTLSASVGDRVTITCRASQSISRWLAWYQQKPGKAPKLLIYKASSLESGVPSRFSGSGSGTEFTLTISSLQPDDFATYYCQQYNSYSTFGQGTKVEIK

SEQ ID NO: 108 - protein, 242 aa, Artificial Sequence
  Description of Artificial Sequence: Synthetic polypeptide
QVQLQQWGGGLLKPSETLSLTCAVYGGSSSGNYWSWIRQPPGKRLEWIGEINHSGTTSYNPSLKSRVTISVDTSKNQFSLKLSSVTAADTAVYYCARGELGIADSWGQGTLVTVSSGGGGSGGGGSGGGGSGGGGSDIQMTQSPSTLSASVGDRVTITCRASQSISRWLAWYQQKPGKAPKLLIYKASSLESGVPSRFSGSGSGTEFTLTISSLQPDDFATYYCQQYNSYSTFGQGTKVEIK

SEQ ID NO: 109 - protein, 11 aa, Artificial Sequence
  Description of Artificial Sequence: Synthetic peptide
GSISSSSYYWG

SEQ ID NO: 110 - protein, 12 aa, Artificial Sequence
  Description of Artificial Sequence: Synthetic peptide
GSIYYSGNIYHN

SEQ ID NO: 111 - protein, 15 aa, Artificial Sequence
  Description of Artificial Sequence: Synthetic peptide
CAREIIVGATHFDYW

SEQ ID NO: 112 - protein, 11 aa, Artificial Sequence
  Description of Artificial Sequence: Synthetic peptide
RASQGIRNDLG

SEQ ID NO: 113 - protein, 7 aa, Artificial Sequence
  Description of Artificial Sequence: Synthetic peptide
AASSLQS

SEQ ID NO: 114 - protein, 11 aa, Artificial Sequence [sequence omitted]

SEQ ID NO: 115 - protein, 121 aa, Artificial Sequence
  Description of Artificial Sequence: Synthetic polypeptide
QLQLQESGPGLVKPSETLSLTCTVSGGSISSSSYYWGWIRQPPGKGLEWIGSIYYSGNIYHNPSLKSRVSISVDTSKNQFSLRLSSVTAADTAVYYCAREIIVGATHFDYWGQGTLVTVSS

SEQ ID NO: 116 - protein, 107 aa, Artificial Sequence
  Description of Artificial Sequence: Synthetic polypeptide
AIQMTQSPSSLSASVGDRVTITCRASQGIRNDLGWYQQKPGKAPELLIYAASSLQSGVPSRFSGSGSGTDFTLTISSLQPEDFATYYCLQDYNYPLTFGPGTKVDIK

SEQ ID NO: 117 - protein, 248 aa, Artificial Sequence
  Description of Artificial Sequence: Synthetic polypeptide
QLQLQESGPGLVKPSETLSLTCTVSGGSISSSSYYWGWIRQPPGKGLEWIGSIYYSGNIYHNPSLKSRVSISVDTSKNQFSLRLSSVTAADTAVYYCAREIIVGATHFDYWGQGTLVTVSSGGGGSGGGGSGGGGSGGGGSAIQMTQSPSSLSASVGDRVTITCRASQGIRNDLGWYQQKPGKAPELLIYAASSLQSGVPSRFSGSGSGTDFTLTISSLQPEDFATYYCLQDYNYPLTFGPGTKVDIK

SEQ ID NO: 118 - protein, 9 aa, Artificial Sequence
  Description of Artificial Sequence: Synthetic peptide
GSFSGYYWS

SEQ ID NO: 119 - protein, 12 aa, Artificial Sequence
  Description of Artificial Sequence: Synthetic peptide
GEIIHSGSSNYN

SEQ ID NO: 120 - protein, 15 aa, Artificial Sequence
  Description of Artificial Sequence: Synthetic peptide
CSRGEYGSGSRFDYW

SEQ ID NO: 121 - protein, 11 aa, Artificial Sequence
  Description of Artificial Sequence: Synthetic peptide
RASQGIRDDLG

SEQ ID NO: 122 - protein, 7 aa, Artificial Sequence
  Description of Artificial Sequence: Synthetic peptide
AASSLQS

SEQ ID NO: 123 - protein, 11 aa, Artificial Sequence [sequence omitted]

SEQ ID NO: 124 - protein, 119 aa, Artificial Sequence
  Description of Artificial Sequence: Synthetic polypeptide
QVQLQQWGAGLLKPSETLSLTCAVYGGSFSGYYWSWIRQPPGKGLEWIGEIIHSGSSNYNPSLKSRVSISVDTSKNQFSLKLSSVTAADTAVYYCSRGEYGSGSRFDYWGQGTLVTVSS

SEQ ID NO: 125 - protein, 107 aa, Artificial Sequence
  Description of Artificial Sequence: Synthetic polypeptide
AIQMTQSPSSLSASVGDRVAITCRASQGIRDDLGWYQQKPGKAPKLLIYAASSLQSGVPSRFSGSRSDTDFTLTISSLQPEDFATYYCLQDYDYPLTFGGGTKVEIK

SEQ ID NO: 126 - protein, 246 aa, Artificial Sequence
  Description of Artificial Sequence: Synthetic polypeptide
QVQLQQWGAGLLKPSETLSLTCAVYGGSFSGYYWSWIRQPPGKGLEWIGEIIHSGSSNYNPSLKSRVSISVDTSKNQFSLKLSSVTAADTAVYYCSRGEYGSGSRFDYWGQGTLVTVSSGGGGSGGGGSGGGGSGGGGSAIQMTQSPSSLSASVGDRVAITCRASQGIRDDLGWYQQKPGKAPKLLIYAASSLQSGVPSRFSGSRSDTDFTLTISSLQPEDFATYYCLQDYDYPLTFGGGTKVEIK

SEQ ID NO: 127 - protein, 10 aa, Artificial Sequence
  Description of Artificial Sequence: Synthetic peptide
GSISSNNWWS

SEQ ID NO: 128 - protein, 12 aa, Artificial Sequence
  Description of Artificial Sequence: Synthetic peptide
GDIHHSGSTNYK

SEQ ID NO: 129 - protein, 12 aa, Artificial Sequence
  Description of Artificial Sequence: Synthetic peptide
CAREAGGYFDYW

SEQ ID NO: 130 - protein, 11 aa, Artificial Sequence
  Description of Artificial Sequence: Synthetic peptide
RASQSISSWLA

SEQ ID NO: 131 - protein, 7 aa, Artificial Sequence
  Description of Artificial Sequence: Synthetic peptide
KASSLES

SEQ ID NO: 132 - protein, 10 aa, Artificial Sequence [sequence omitted]

SEQ ID NO: 133 - protein, 117 aa, Artificial Sequence
  Description of Artificial Sequence: Synthetic polypeptide
QVQLQESGPGLVKPSGTLSLTCAVSGGSISSNNWWSWVRQPPGKGLEWIGDIHHSGSTNYKPSLKSRVTISVDKSKNQFSLNLISVTAADTAVYYCAREAGGYFDYWGQGILVTVSS

SEQ ID NO: 134 - protein, 106 aa, Artificial Sequence
  Description of Artificial Sequence: Synthetic polypeptide
DIQMTQSPSTLSASVGDRVTITCRASQSISSWLAWYQQKPGKAPKLLISKASSLESGVPSRFSGSGSGPEFTLTISSLQPADFATYYCQQYNSYSTFGQGTKLEIK

SEQ ID NO: 135 - protein, 243 aa, Artificial Sequence
  Description of Artificial Sequence: Synthetic polypeptide
QVQLQESGPGLVKPSGTLSLTCAVSGGSISSNNWWSWVRQPPGKGLEWIGDIHHSGSTNYKPSLKSRVTISVDKSKNQFSLNLISVTAADTAVYYCAREAGGYFDYWGQGILVTVSSGGGGSGGGGSGGGGSGGGGSDIQMTQSPSTLSASVGDRVTITCRASQSISSWLAWYQQKPGKAPKLLISKASSLESGVPSRFSGSGSGPEFTLTISSLQPADFATYYCQQYNSYSTFGQGTKLEIK

SEQ ID NO: 136 - protein, 9 aa, Artificial Sequence
  Description of Artificial Sequence: Synthetic peptide
GSFSGYYWT

SEQ ID NO: 137 - protein, 12 aa, Artificial Sequence
  Description of Artificial Sequence: Synthetic peptide
GEITHSGSTNYN

SEQ ID NO: 138 - protein, 15 aa, Artificial Sequence
  Description of Artificial Sequence: Synthetic peptide
CARGEYGSGSRFDYW

SEQ ID NO: 139 - protein, 11 aa, Artificial Sequence
  Description of Artificial Sequence: Synthetic peptide
RASQGIRDDLG

SEQ ID NO: 140 - protein, 7 aa, Artificial Sequence
  Description of Artificial Sequence: Synthetic peptide
AASSLQS

SEQ ID NO: 141 - protein, 11 aa, Artificial Sequence [sequence omitted]

SEQ ID NO: 142 - protein, 119 aa, Artificial Sequence
  Description of Artificial Sequence: Synthetic polypeptide
QVQLQQWGAGLLKPSETLSLTCAVYGGSFSGYYWTWIRQPPGKGLEWIGEITHSGSTNYNPSLKSRVSISVDTSKNQFSLKLSSVTAADTAVYYCARGEYGSGSRFDYWGQGTLVTVSS

SEQ ID NO: 143 - protein, 107 aa, Artificial Sequence
  Description of Artificial Sequence: Synthetic polypeptide
AIQMTQSPSSLSASVGDRVAITCRASQGIRDDLGWYQQKPGKAPKLLIYAASSLQSGVPSRFSGSGSDTDFTLTISSLQPEDFATYYCLQDYDYPLTFGGGTKVEIK

SEQ ID NO: 144 - protein, 246 aa, Artificial Sequence
  Description of Artificial Sequence: Synthetic polypeptide
QVQLQQWGAGLLKPSETLSLTCAVYGGSFSGYYWTWIRQPPGKGLEWIGEITHSGSTNYNPSLKSRVSISVDTSKNQFSLKLSSVTAADTAVYYCARGEYGSGSRFDYWGQGTLVTVSSGGGGSGGGGSGGGGSGGGGSAIQMTQSPSSLSASVGDRVAITCRASQGIRDDLGWYQQKPGKAPKLLIYAASSLQSGVPSRFSGSGSDTDFTLTISSLQPEDFATYYCLQDYDYPLTFGGGTKVEIK

SEQ ID NO: 145 - protein, 9 aa, Artificial Sequence
  Description of Artificial Sequence: Synthetic peptide
GSFSGYYWS

SEQ ID NO: 146 - protein, 12 aa, Artificial Sequence
  Description of Artificial Sequence: Synthetic peptide
GEITHSGSTNYN

SEQ ID NO: 147 - protein, 15 aa, Artificial Sequence
  Description of Artificial Sequence: Synthetic peptide
CARGEYGSGSRFDYW

SEQ ID NO: 148 - protein, 11 aa, Artificial Sequence
  Description of Artificial Sequence: Synthetic peptide
RASQGIRDDLG

SEQ ID NO: 149 - protein, 7 aa, Artificial Sequence
  Description of Artificial Sequence: Synthetic peptide
AASSLQS

SEQ ID NO: 150 - protein, 11 aa, Artificial Sequence [sequence omitted]

SEQ ID NO: 151 - protein, 119 aa, Artificial Sequence
  Description of Artificial Sequence: Synthetic polypeptide
QVQLQQWGAGLLKPSETLSLTCAVYGGSFSGYYWSWIRQPPGKGLEWIGEITHSGSTNYNPSLKSRVSISVDTSKNQFSLKLSSVTAADTAVYYCARGEYGSGSRFDYWGQGTLVTVSS

SEQ ID NO: 152 - protein, 107 aa, Artificial Sequence
  Description of Artificial Sequence: Synthetic polypeptide
AIQMTQSPSSLSASVGDRVALTCRASQGIRDDLGWYQQKPGKAPKLLIYAASSLQSGVPSRFSGSGSDTDFTLTISSLQPEDFATYYCLQDYDYPLTFGGGTKVEIK

SEQ ID NO: 153 - protein, 246 aa, Artificial Sequence
  Description of Artificial Sequence: Synthetic polypeptide
QVQLQQWGAGLLKPSETLSLTCAVYGGSFSGYYWSWIRQPPGKGLEWIGEITHSGSTNYNPSLKSRVSISVDTSKNQFSLKLSSVTAADTAVYYCARGEYGSGSRFDYWGQGTLVTVSSGGGGSGGGGSGGGGSGGGGSAIQMTQSPSSLSASVGDRVALTCRASQGIRDDLGWYQQKPGKAPKLLIYAASSLQSGVPSRFSGSGSDTDFTLTISSLQPEDFATYYCLQDYDYPLTFGGGTKVEIK

SEQ ID NO: 154 - protein, 9 aa, Artificial Sequence
  Description of Artificial Sequence: Synthetic peptide
GSFSAYYWN

SEQ ID NO: 155 - protein, 12 aa, Artificial Sequence
  Description of Artificial Sequence: Synthetic peptide
GEINHSGSTNYN

SEQ ID NO: 156 - protein, 16 aa, Artificial Sequence
  Description of Artificial Sequence: Synthetic peptide
CARGLDSSGWYPFDYW

SEQ ID NO: 157 - protein, 11 aa, Artificial Sequence
  Description of Artificial Sequence: Synthetic peptide
RASQGISSWLA

SEQ ID NO: 158 - protein, 7 aa, Artificial Sequence
  Description of Artificial Sequence: Synthetic peptide
AASSLQS

SEQ ID NO: 159 - protein, 11 aa, Artificial Sequence [sequence omitted]

SEQ ID NO: 160 - protein, 120 aa, Artificial Sequence
  Description of Artificial Sequence: Synthetic polypeptide
QVQLQQWGAGLLKPSETLSLTCAVYGGSFSAYYWNWIRQPPGKGLEWIGEINHSGSTNYNPSLKSRVTISVDTSKNQFSLNLTSLTAADTAVYYCARGLDSSGWYPFDYWGQGTLVTVSS

SEQ ID NO: 161 - protein, 107 aa, Artificial Sequence
  Description of Artificial Sequence: Synthetic polypeptide
DIQMTQSPSSVSASVGDRVTITCRASQGISSWLAWYQQKPGKAPKLLIYAASSLQSGVPSRFSGSGSGTDFTLTISSLQPEDFATYYCQQADSFPFTFGPGTKVDIK

SEQ ID NO: 162 - protein, 247 aa, Artificial Sequence
  Description of Artificial Sequence: Synthetic polypeptide
QVQLQQWGAGLLKPSETLSLTCAVYGGSFSAYYWNWIRQPPGKGLEWIGEINHSGSTNYNPSLKSRVTISVDTSKNQFSLNLTSLTAADTAVYYCARGLDSSGWYPFDYWGQGTLVTVSSGGGGSGGGGSGGGGSGGGGSDIQMTQSPSSVSASVGDRVTITCRASQGISSWLAWYQQKPGKAPKLLIYAASSLQSGVPSRFSGSGSGTDFTLTISSLQPEDFATYYCQQADSFPFTFGPGTKVDIK

SEQ ID NO: 163 - protein, 9 aa, Artificial Sequence
  Description of Artificial Sequence: Synthetic peptide
GSFSGDYWS

SEQ ID NO: 164 - protein, 12 aa, Artificial Sequence
  Description of Artificial Sequence: Synthetic peptide
GEINHSGITSFN

SEQ ID NO: 165 - protein, 12 aa, Artificial Sequence
  Description of Artificial Sequence: Synthetic peptide
CARGELGIPDNW

SEQ ID NO: 166 - protein, 11 aa, Artificial Sequence
  Description of Artificial Sequence: Synthetic peptide
RASQSISRWLA

SEQ ID NO: 167 - protein, 7 aa, Artificial Sequence
  Description of Artificial Sequence: Synthetic peptide
KASSLES

SEQ ID NO: 168 - protein, 10 aa, Artificial Sequence [sequence omitted]

SEQ ID NO: 169 - protein, 116 aa, Artificial Sequence
  Description of Artificial Sequence: Synthetic polypeptide
QVQLQQWGAGLLKPSETLSLTCAVFGGSFSGDYWSWIRQPPGKGLEWIGEINHSGITSFNPSLKSRVTISVDTSKNQFSLKLSSVTAADTAVYYCARGELGIPDNWGQGTLVTVSS

SEQ ID NO: 170 - protein, 106 aa, Artificial Sequence; identical to SEQ ID NO: 107
  Description of Artificial Sequence: Synthetic polypeptide

SEQ ID NO: 171 - protein, 242 aa, Artificial Sequence
  Description of Artificial Sequence: Synthetic polypeptide
QVQLQQWGAGLLKPSETLSLTCAVFGGSFSGDYWSWIRQPPGKGLEWIGEINHSGITSFNPSLKSRVTISVDTSKNQFSLKLSSVTAADTAVYYCARGELGIPDNWGQGTLVTVSSGGGGSGGGGSGGGGSGGGGSDIQMTQSPSTLSASVGDRVTITCRASQSISRWLAWYQQKPGKAPKLLIYKASSLESGVPSRFSGSGSGTEFTLTISSLQPDDFATYYCQQYNSYSTFGQGTKVEIK

SEQ ID NO: 172 - protein, 10 aa, Artificial Sequence
  Description of Artificial Sequence: Synthetic peptide
DSISSSNWWS

SEQ ID NO: 173 - protein, 12 aa, Artificial Sequence
  Description of Artificial Sequence: Synthetic peptide
GEVFHSGSTNYN

SEQ ID NO: 174 - protein, 13 aa, Artificial Sequence
  Description of Artificial Sequence: Synthetic peptide
CARAAVAGALDYW

SEQ ID NO: 175 - protein, 17 aa, Artificial Sequence
  Description of Artificial Sequence: Synthetic peptide
KSSQSVLYSSNNKNYLA

SEQ ID NO: 176 - protein, 7 aa, Artificial Sequence
  Description of Artificial Sequence: Synthetic peptide
WASTRES

SEQ ID NO: 177 - protein, 11 aa, Artificial Sequence [sequence omitted]

SEQ ID NO: 178 - protein, 118 aa, Artificial Sequence
  Description of Artificial Sequence: Synthetic polypeptide
QVQLQESGPGLVKPSGTLSLTCVVFGDSISSSNWWSWVRQPPGKGLEWIGEVFHSGSTNYNPSLKSRVTISVDKSKNQFSLKLSSVTAADTAVYYCARAAVAGALDYWGQGTLVTVSS

SEQ ID NO: 179 - protein, 113 aa, Artificial Sequence
  Description of Artificial Sequence: Synthetic polypeptide
DIVMTQSPDSLAVSLGERATINCKSSQSVLYSSNNKNYLAWYQQKPGQPPNLLVYWASTRESGVPDRFSGAGSGTDFTLTISSLQAEDVAVYYCQQYYGTSWTFGQGTKVEIK

SEQ ID NO: 180 - protein, 251 aa, Artificial Sequence
  Description of Artificial Sequence: Synthetic polypeptide
QVQLQESGPGLVKPSGTLSLTCVVFGDSISSSNWWSWVRQPPGKGLEWIGEVFHSGSTNYNPSLKSRVTISVDKSKNQFSLKLSSVTAADTAVYYCARAAVAGALDYWGQGTLVTVSSGGGGSGGGGSGGGGSGGGGSDIVMTQSPDSLAVSLGERATINCKSSQSVLYSSNNKNYLAWYQQKPGQPPNLLVYWASTRESGVPDRFSGAGSGTDFTLTISSLQAEDVAVYYCQQYYGTSWTFGQGTKVEIK

SEQ ID NO: 181 - protein, 11 aa, Artificial Sequence
  Description of Artificial Sequence: Synthetic peptide
FSLSTSGLGVG

SEQ ID NO: 182 - protein, 12 aa, Artificial Sequence
  Description of Artificial Sequence: Synthetic peptide
ALIYWNDDKRYS

SEQ ID NO: 183 - protein, 14 aa, Artificial Sequence
  Description of Artificial Sequence: Synthetic peptide
CVHRRIAAPGSVYW

SEQ ID NO: 184 - protein, 11 aa, Artificial Sequence
  Description of Artificial Sequence: Synthetic peptide
RASQGISSWLA

SEQ ID NO: 185 - protein, 7 aa, Artificial Sequence
  Description of Artificial Sequence: Synthetic peptide
AASSLQS

SEQ ID NO: 186 - protein, 11 aa, Artificial Sequence
  Description of Artificial Sequence: Synthetic peptide
CHQANSFPFTF

SEQ ID NO: 187 - protein, 120 aa, Artificial Sequence
  Description of Artificial Sequence: Synthetic polypeptide
QITLRESGPTLVKPTQTLTLTCTFSGFSLSTSGLGVGWIRQPPGEALEWLALIYWNDDKRYSPSLKSRLSITKDTSKNQVVLIMTNMDPVDTATYYCVHRRIAAPGSVYWGQGTLVTVSS

SEQ ID NO: 188 - protein, 107 aa, Artificial Sequence
  Description of Artificial Sequence: Synthetic polypeptide
DIQMTQSPSSVSASVGDRVTITCRASQGISSWLAWYQQKPGKAPKLLISAASSLQSGVPSRFSGSGSGTDFTLTISSLQPEDFATYYCHQANSFPFTFGQGTKLEIK

SEQ ID NO: 189 - protein, 247 aa, Artificial Sequence
  Description of Artificial Sequence: Synthetic polypeptide
QITLRESGPTLVKPTQTLTLTCTFSGFSLSTSGLGVGWIRQPPGEALEWLALIYWNDDKRYSPSLKSRLSITKDTSKNQVVLIMTNMDPVDTATYYCVHRRIAAPGSVYWGQGTLVTVSSGGGGSGGGGSGGGGSGGGGSDIQMTQSPSSVSASVGDRVTITCRASQGISSWLAWYQQKPGKAPKLLISAASSLQSGVPSRFSGSGSGTDFTLTISSLQPEDFATYYCHQANSFPFTFGQGTKLEIK

SEQ ID NO: 190 - protein, 9 aa, Artificial Sequence
  Description of Artificial Sequence: Synthetic peptide
YTLTELSMH

SEQ ID NO: 191 - protein, 13 aa, Artificial Sequence
  Description of Artificial Sequence: Synthetic peptide
GGFDPEDGKTIYA

SEQ ID NO: 192 - protein, 14 aa, Artificial Sequence
  Description of Artificial Sequence: Synthetic peptide
CATLLRGLDAFDVW

SEQ ID NO: 193 - protein, 11 aa, Artificial Sequence
  Description of Artificial Sequence: Synthetic peptide
RASQGIRNDLG

SEQ ID NO: 194 - protein, 7 aa, Artificial Sequence
  Description of Artificial Sequence: Synthetic peptide
AASSLQS

SEQ ID NO: 195 - protein, 11 aa, Artificial Sequence [sequence omitted]

SEQ ID NO: 196 - protein, 119 aa, Artificial Sequence
  Description of Artificial Sequence: Synthetic polypeptide
QVQLVQSGAEVKKPGASVKVSCKVSGYTLTELSMHWVRQAPGKGPEGMGGFDPEDGKTIYAQKFQGRVTMTEDTSADTAYMELNSLRSEDTAVYYCATLLRGLDAFDVWGQGTMVTVSS

SEQ ID NO: 197 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISTLQPEDFATYYCLQHNSYPRTFGQGTKVEIK

SEQ ID NO: 198 - protein, 246 aa, Artificial Sequence
  Description of Artificial Sequence: Synthetic polypeptide
QVQLVQSGAEVKKPGASVKVSCKVSGYTLTELSMHWVRQAPGKGPEGMGGFDPEDGKTIYAQKFQGRVTMTEDTSADTAYMELNSLRSEDTAVYYCATLLRGLDAFDVWGQGTMVTVSSGGGGSGGGGSGGGGSGGGGSDIQMTQSPSSLSASVGDRVTITCRASQGIRNDLGWYQQKPGKAPKRLIYAASSLQSGVPSRFSGSGSGTEFTLTISTLQPEDFATYYCLQHNSYPRTFGQGTKVEIK

SEQ ID NO: 199 - protein, 9 aa, Artificial Sequence
  Description of Artificial Sequence: Synthetic peptide
GSFSGYYWR

SEQ ID NO: 200 - protein, 12 aa, Artificial Sequence
  Description of Artificial Sequence: Synthetic peptide
GEISHSGSTNYN

SEQ ID NO: 201 - protein, 16 aa, Artificial Sequence
  Description of Artificial Sequence: Synthetic peptide
CAVRGYSYGYPLFDYW

SEQ ID NO: 202 - protein, 11 aa, Artificial Sequence
  Description of Artificial Sequence: Synthetic peptide
RASQGIRNDLG

SEQ ID NO: 203 - protein, 7 aa, Artificial Sequence
  Description of Artificial Sequence: Synthetic peptide
AASSLQS

SEQ ID NO: 204 - protein, 11 aa, Artificial Sequence [sequence omitted]

SEQ ID NO: 205 - protein, 120 aa, Artificial Sequence
  Description of Artificial Sequence: Synthetic polypeptide
QVQLQQWGAGLLKPSETLSLTCAVYGGSFSGYYWRWIRQPPGKGLEWIGEISHSGSTNYNPSLKSRVTISVDTSKNQFSLKLSSVTAADTAVYYCAVRGYSYGYPLFDYWGQGTLVTVSS

SEQ ID NO: 206 - protein, 107 aa, Artificial Sequence
  Description of Artificial Sequence: Synthetic polypeptide
DIQMTQSPSSLSASVGDRVTITCRASQGIRNDLGWYQQKLGKAPKRLIYAASSLQSGVPSRFSGSGSGTEFTLTISSLQPEDFATYYCLQYNSYPRTFGQGTKVEIK

SEQ ID NO: 207 - protein, 247 aa, Artificial Sequence
  Description of Artificial Sequence: Synthetic polypeptide
QVQLQQWGAGLLKPSETLSLTCAVYGGSFSGYYWRWIRQPPGKGLEWIGEISHSGSTNYNPSLKSRVTISVDTSKNQFSLKLSSVTAADTAVYYCAVRGYSYGYPLFDYWGQGTLVTVSSGGGGSGGGGSGGGGSGGGGSDIQMTQSPSSLSASVGDRVTITCRASQGIRNDLGWYQQKLGKAPKRLIYAASSLQSGVPSRFSGSGSGTEFTLTISSLQPEDFATYYCLQYNSYPRTFGQGTKVEIK

SEQ ID NO: 208 - protein, 9 aa, Artificial Sequence
  Description of Artificial Sequence: Synthetic peptide
DSISSNWWT

SEQ ID NO: 209 - protein, 12 aa, Artificial Sequence
  Description of Artificial Sequence: Synthetic peptide
GDIHHSGSTNYN

SEQ ID NO: 210 - protein, 12 aa, Artificial Sequence
  Description of Artificial Sequence: Synthetic peptide
CARDGGGTLDYW

SEQ ID NO: 211 - protein, 11 aa, Artificial Sequence
  Description of Artificial Sequence: Synthetic peptide
RASQSISSWLA

SEQ ID NO: 212 - protein, 7 aa, Artificial Sequence
  Description of Artificial Sequence: Synthetic peptide
KASTLES

SEQ ID NO: 213 - protein, 10 aa, Artificial Sequence [sequence omitted]

SEQ ID NO: 214 - protein, 116 aa, Artificial Sequence
  Description of Artificial Sequence: Synthetic polypeptide
QVQLQESGPGLVKPSGTLSLTCAVSGDSISSNWWTWVRQPPGKGLEWIGDIHHSGSTNYNPSLKSRVTMSVDKSENQFSLKLSSVTAADTAVFYCARDGGGTLDYWGQGTLVTVSS

SEQ ID NO: 215 - protein, 106 aa, Artificial Sequence
  Description of Artificial Sequence: Synthetic polypeptide
DIQMTQSPSTLSASVGDRVTITCRASQSISSWLAWYQQKPGKAPKLLIYKASTLESGVPSRFSGSGSGTEFTLTISSLQPDDFATYYCQQYNGYSTFGQGTKVEIK

SEQ ID NO: 216 - protein, 242 aa, Artificial Sequence
  Description of Artificial Sequence: Synthetic polypeptide
QVQLQESGPGLVKPSGTLSLTCAVSGDSISSNWWTWVRQPPGKGLEWIGDIHHSGSTNYNPSLKSRVTMSVDKSENQFSLKLSSVTAADTAVFYCARDGGGTLDYWGQGTLVTVSSGGGGSGGGGSGGGGSGGGGSDIQMTQSPSTLSASVGDRVTITCRASQSISSWLAWYQQKPGKAPKLLIYKASTLESGVPSRFSGSGSGTEFTLTISSLQPDDFATYYCQQYNGYSTFGQGTKVEIK

SEQ ID NO: 217 - protein, 9 aa, Artificial Sequence
  Description of Artificial Sequence: Synthetic peptide
GTFTNYCIS

SEQ ID NO: 218 - protein, 13 aa, Artificial Sequence
  Description of Artificial Sequence: Synthetic peptide
GGIIPIFGTTNYA

SEQ ID NO: 219 - protein, 16 aa, Artificial Sequence
  Description of Artificial Sequence: Synthetic peptide
CARDNGDRYYYDMDVW

SEQ ID NO: 220 - protein, 13 aa, Artificial Sequence
  Description of Artificial Sequence: Synthetic peptide
SGSSSNIGNNYVS

SEQ ID NO: 221 - protein, 7 aa, Artificial Sequence
  Description of Artificial Sequence: Synthetic peptide
DNNKRPS

SEQ ID NO: 222 - protein, 13 aa, Artificial Sequence [sequence omitted]

SEQ ID NO: 223 - protein, 121 aa, Artificial Sequence
  Description of Artificial Sequence: Synthetic polypeptide
QVQLVQSGAEVKKPGSSVKVSCKASGGTFTNYCISWVRQAPGQGLEWMGGIIPIFGTTNYAQTFQGRVTITADKSTSTAYMELSSLRSEDTAVYYCARDNGDRYYYDMDVWGQGTTVTVSS

SEQ ID NO: 224 - protein, 110 aa, Artificial Sequence
  Description of Artificial Sequence: Synthetic polypeptide
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAVVFGGGTKLTVL

SEQ ID NO: 225 - protein, 251 aa, Artificial Sequence
  Description of Artificial Sequence: Synthetic polypeptide
QVQLVQSGAEVKKPGSSVKVSCKASGGTFTNYCISWVRQAPGQGLEWMGGIIPIFGTTNYAQTFQGRVTITADKSTSTAYMELSSLRSEDTAVYYCARDNGDRYYYDMDVWGQGTTVTVSSGGGGSGGGGSGGGGSGGGGSQSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAVVFGGGTKLTVL

SEQ ID NO: 226 - protein, 9 aa, Artificial Sequence
  Description of Artificial Sequence: Synthetic peptide
GTFSTYSIS

SEQ ID NO: 227 - protein, 13 aa, Artificial Sequence
  Description of Artificial Sequence: Synthetic peptide
GGIIPIFGTTNYA

SEQ ID NO: 228 - protein, 18 aa, Artificial Sequence
  Description of Artificial Sequence: Synthetic peptide
CARDGEGSYYYYYGMDVW

SEQ ID NO: 229 - protein, 13 aa, Artificial Sequence
  Description of Artificial Sequence: Synthetic peptide
SGSSSNIGNNYVS

SEQ ID NO: 230 - protein, 7 aa, Artificial Sequence
  Description of Artificial Sequence: Synthetic peptide
DNNKRPS

SEQ ID NO: 231 - protein, 13 aa, Artificial Sequence [sequence omitted]

SEQ ID NO: 232 - protein, 123 aa, Artificial Sequence
  Description of Artificial Sequence: Synthetic polypeptide
QVPLVQSGAEVKKPGSSVKVSCKASGGTFSTYSISWVRQAPGQGLEWMGGIIPIFGTTNYAQKFQGRVTITADKSTSTAYMELSSLRSEDTAVYYCARDGEGSYYYYYGMDVWGQGTTVTVSS

SEQ ID NO: 233 - protein, 110 aa, Artificial Sequence
  Description of Artificial Sequence: Synthetic polypeptide
QSVLTQPPSVSAAPGQKVTISCSGSSSNIGNNYVSWYQQLPGTAPKLLIYDNNKRPSGIPDRFFGSKFGTSATLGITGLQTGDEADYYCGTWDSSLSAVVFGGGTKLTVL

SEQ ID NO: 234 - protein, 253 aa, Artificial Sequence
  Description of Artificial Sequence: Synthetic polypeptide
QVPLVQSGAEVKKPGSSVKVSCKASGGTFSTYSISWVRQAPGQGLEWMGGIIPIFGTTNYAQKFQGRVTITADKSTSTAYMELSSLRSEDTAVYYCARDGEGSYYYYYGMDVWGQGTTVTVSSGGGGSGGGGSGGGGSGGGGSQSVLTQPPSVSAAPGQKVTISCSGSSSNIGNNYVSWYQQLPGTAPKLLIYDNNKRPSGIPDRFFGSKFGTSATLGITGLQTGDEADYYCGTWDSSLSAVVFGGGTKLTVL

SEQ ID NO: 235 - protein, 9 aa, Artificial Sequence
  Description of Artificial Sequence: Synthetic peptide
DSISSYYWS

SEQ ID NO: 236 - protein, 12 aa, Artificial Sequence
  Description of Artificial Sequence: Synthetic peptide
GYMYYSGITNYN

SEQ ID NO: 237 - protein, 14 aa, Artificial Sequence
  Description of Artificial Sequence: Synthetic peptide
CARLSVAGFYFDYW

SEQ ID NO: 238 - protein, 12 aa, Artificial Sequence
  Description of Artificial Sequence: Synthetic peptide
RASQSVTRSYLA

SEQ ID NO: 239 - protein, 7 aa, Artificial Sequence
  Description of Artificial Sequence: Synthetic peptide
GASSRAT

SEQ ID NO: 240 - protein, 11 aa, Artificial Sequence [sequence omitted]

SEQ ID NO: 241 - protein, 118 aa, Artificial Sequence
  Description of Artificial Sequence: Synthetic polypeptide
QVQLQESGPGLVKPSETLSLTCTVSGDSISSYYWSWIRQPPGKGLEWIGYMYYSGITNYNPSLKSRVNISLDTSKNQFSLKLGSVTAADTAVYYCARLSVAGFYFDYWGQGTLVTVSS

SEQ ID NO: 242 - protein, 108 aa, Artificial Sequence
  Description of Artificial Sequence: Synthetic polypeptide
EIVLTQSPGTLSLSPGERATLSCRASQSVTRSYLAWYQQKPGQAPRLLIYGASSRATDIPDRFSGSGSGTDFTLTINRLEPEDFAVYYCQQYGTSPLTFGGGTKVEIK

SEQ ID NO: 243 - protein, 246 aa, Artificial Sequence
  Description of Artificial Sequence: Synthetic polypeptide
QVQLQESGPGLVKPSETLSLTCTVSGDSISSYYWSWIRQPPGKGLEWIGYMYYSGITNYNPSLKSRVNISLDTSKNQFSLKLGSVTAADTAVYYCARLSVAGFYFDYWGQGTLVTVSSGGGGSGGGGSGGGGSGGGGSEIVLTQSPGTLSLSPGERATLSCRASQSVTRSYLAWYQQKPGQAPRLLIYGASSRATDIPDRFSGSGSGTDFTLTINRLEPEDFAVYYCQQYGTSPLTFGGGTKVEIK

SEQ ID NO: 244 - protein, 9 aa, Artificial Sequence
  Description of Artificial Sequence: Synthetic peptide
DSISSYYWS

SEQ ID NO: 245 - protein, 12 aa, Artificial Sequence
  Description of Artificial Sequence: Synthetic peptide
SYIYYSGISNYN

SEQ ID NO: 246 - protein, 14 aa, Artificial Sequence
  Description of Artificial Sequence: Synthetic peptide
CARISVAGFFFDNW

SEQ ID NO: 247 - protein, 12 aa, Artificial Sequence
  Description of Artificial Sequence: Synthetic peptide
RASQSVSSSYLA

SEQ ID NO: 248 - protein, 7 aa, Artificial Sequence
  Description of Artificial Sequence: Synthetic peptide
GASSRAA

SEQ ID NO: 249 - protein, 11 aa, Artificial Sequence [sequence omitted]

SEQ ID NO: 250 - protein, 118 aa, Artificial Sequence
  Description of Artificial Sequence: Synthetic polypeptide
QVQLQESGPGLVKPSETLSLTCTVSSDSISSYYWSWIRQPPGKGLEWISYIYYSGISNYNPSLKSRVSISVDTSKNQFSLRLSSVTAADTAVYYCARISVAGFFFDNWGQGTLVTVSS

SEQ ID NO: 251 - protein, 108 aa, Artificial Sequence
  Description of Artificial Sequence: Synthetic polypeptide
EIMLTQSPDTLSLSPGERATLSCRASQSVSSSYLAWYQQKPGQAPRLLIYGASSRAAGVPDRFSGSGSGTDFTLTISRLAPEDFVVYYCQQYGISPLTFGGGTKVEIK

SEQ ID NO: 252 - protein, 246 aa, Artificial Sequence
  Description of Artificial Sequence: Synthetic polypeptide
QVQLQESGPGLVKPSETLSLTCTVSSDSISSYYWSWIRQPPGKGLEWISYIYYSGISNYNPSLKSRVSISVDTSKNQFSLRLSSVTAADTAVYYCARISVAGFFFDNWGQGTLVTVSSGGGGSGGGGSGGGGSGGGGSEIMLTQSPDTLSLSPGERATLSCRASQSVSSSYLAWYQQKPGQAPRLLIYGASSRAAGVPDRFSGSGSGTDFTLTISRLAPEDFVVYYCQQYGISPLTFGGGTKVEIK

SEQ ID NO: 253 - protein, 11 aa, Artificial Sequence
  Description of Artificial Sequence: Synthetic peptide
DSVSSNSATWN

SEQ ID NO: 254 - protein, 14 aa, Artificial Sequence
  Description of Artificial Sequence: Synthetic peptide
GRTYYRSKWYDDYA

SEQ ID NO: 255 - protein, 16 aa, Artificial Sequence
  Description of Artificial Sequence: Synthetic peptide
CAGGGLVGAPDGFDVW

SEQ ID NO: 256 - protein, 13 aa, Artificial Sequence
  Description of Artificial Sequence: Synthetic peptide
SGSSSNIGSDPVN

SEQ ID NO: 257 - protein, 7 aa, Artificial Sequence
  Description of Artificial Sequence: Synthetic peptide
SNNQRPS

SEQ ID NO: 258 - protein, 13 aa, Artificial Sequence [sequence omitted]

SEQ ID NO: 259 - protein, 124 aa, Artificial Sequence
  Description of Artificial Sequence: Synthetic polypeptide
QVQLQQSGPGLVKPSQTLSLTCAISGDSVSSNSATWNWIRQSPSRGLEWLGRTYYRSKWYDDYAVSVKSRITINPDTSKNHLSLHLNSVTPEDTAVYYCAGGGLVGAPDGFDVWGQGTMVTVSS

SEQ ID NO: 260 - protein, 110 aa, Artificial Sequence
  Description of Artificial Sequence: Synthetic polypeptide
QSVLTQPPSASGTPGQRVTISCSGSSSNIGSDPVNWYQQLPGTAPKLLIYSNNQRPSGVPDRFSGSKSGTSASLAISGLQSEDEADYYCSAWDDSLNGYVFGTGTKVTVL

SEQ ID NO: 261 - protein, 254 aa, Artificial Sequence
  Description of Artificial Sequence: Synthetic polypeptide
QVQLQQSGPGLVKPSQTLSLTCAISGDSVSSNSATWNWIRQSPSRGLEWLGRTYYRSKWYDDYAVSVKSRITINPDTSKNHLSLHLNSVTPEDTAVYYCAGGGLVGAPDGFDVWGQGTMVTVSSGGGGSGGGGSGGGGSGGGGSQSVLTQPPSASGTPGQRVTISCSGSSSNIGSDPVNWYQQLPGTAPKLLIYSNNQRPSGVPDRFSGSKSGTSASLAISGLQSEDEADYYCSAWDDSLNGYVFGTGTKVTVL

SEQ ID NO: 262 - protein, 9 aa, Artificial Sequence
  Description of Artificial Sequence: Synthetic peptide
YTFTGYSIH

SEQ ID NO: 263 - protein, 13 aa, Artificial Sequence
  Description of Artificial Sequence: Synthetic peptide
GWINPNSGGTFYA

SEQ ID NO: 264 - protein, 17 aa, Artificial Sequence
  Description of Artificial Sequence: Synthetic peptide
CARDGWGDYYYYGLDVW

SEQ ID NO: 265 - protein, 11 aa, Artificial Sequence
  Description of Artificial Sequence: Synthetic peptide
RASQDISSWLA

SEQ ID NO: 266 - protein, 7 aa, Artificial Sequence
  Description of Artificial Sequence: Synthetic peptide
TASSLQG

SEQ ID NO: 267 - protein, 11 aa, Artificial Sequence [sequence omitted]

SEQ ID NO: 268 - protein, 122 aa, Artificial Sequence
  Description of Artificial Sequence: Synthetic polypeptide
QVQLVQSGAEVKKPGASVKVSCKASGYTFTGYSIHWVRQAPGQGLEWMGWINPNSGGTFYAQKFQGRVTMTRDTSISTVYMELSRLRSDDTAVYYCARDGWGDYYYYGLDVWGQGTTVTVSL

SEQ ID NO: 269 - protein, 107 aa, Artificial Sequence
  Description of Artificial Sequence: Synthetic polypeptide
DIQMTQSPSSVSASVGDRVTITCRASQDISSWLAWYQQKPGKAPKLLIYTASSLQGGVPSRFSGSGSGTDFTLTISSLQPEDLATYSCQQANVFPYTFGQGTKLEIK

SEQ ID NO: 270 - protein, 249 aa, Artificial Sequence
  Description of Artificial Sequence: Synthetic polypeptide
QVQLVQSGAEVKKPGASVKVSCKASGYTFTGYSIHWVRQAPGQGLEWMGWINPNSGGTFYAQKFQGRVTMTRDTSISTVYMELSRLRSDDTAVYYCARDGWGDYYYYGLDVWGQGTTVTVSLGGGGSGGGGSGGGGSGGGGSDIQMTQSPSSVSASVGDRVTITCRASQDISSWLAWYQQKPGKAPKLLIYTASSLQGGVPSRFSGSGSGTDFTLTISSLQPEDLATYSCQQANVFPYTFGQGTKLEIK

SEQ ID NO: 271 - protein, 9 aa, Artificial Sequence
  Description of Artificial Sequence: Synthetic peptide
FTFSSYAMN

SEQ ID NO: 272 - protein, 13 aa, Artificial Sequence
  Description of Artificial Sequence: Synthetic peptide
STISGSGGSTYYA

SEQ ID NO: 273 - protein, 17 aa, Artificial Sequence
  Description of Artificial Sequence: Synthetic peptide
CAIDPEYYDILTGGDYW

SEQ ID NO: 274 - protein, 11 aa, Artificial Sequence
  Description of Artificial Sequence: Synthetic peptide
RASQGISNYLA

SEQ ID NO: 275 - protein, 7 aa, Artificial Sequence
  Description of Artificial Sequence: Synthetic peptide
AASSLQS

SEQ ID NO: 276 - protein, 11 aa, Artificial Sequence
  Description of Artificial Sequence: Synthetic peptide
CLQHDSFPLTF

SEQ ID NO: 277 - protein, 122 aa, Artificial Sequence
  Description of Artificial Sequence: Synthetic polypeptide
EVQLLESGGGLVQPGGSLRLSCAASGFTFSSYAMNWVRQAPGKGLEWVSTISGSGGSTYYADSVKGRFTISRDNSKNTLYLQMNSLRAEDTAVFYCAIDPEYYDILTGGDYWGQGTLVTVSS

SEQ ID NO: 278 - protein, 107 aa, Artificial Sequence
  Description of Artificial Sequence: Synthetic polypeptide
DIQMTQSPSAMSASVGDRVTITCRASQGISNYLAWFQQKPGKVPKRLIYAASSLQSGVPSRFSGSGSGTEFTLTISSLQPEDFATYFCLQHDSFPLTFGGGTKVEIK

SEQ ID NO: 279 - protein, 250 aa, Artificial Sequence
  Description of Artificial Sequence: Synthetic polypeptide
EVQLLESGGGLVQPGGSLRLSCAASGFTFSSYAMNWVRQAPGKGLEWVSTISGSGGSTYYADSVKGRFTISRDNSKNTLYLQMNSLRAEDTAVFYCAIDPEYYDILTGGDYWGQGTLVTVSSGGGGSGGGGSGGGGGSGGGGSDIQMTQSPSAMSASVGDRVTITCRASQGISNYLAWFQQKPGKVPKRLIYAASSLQSGVPSRFSGSGSGTEFTLTISSLQPEDFATYFCLQHDSFPLTFGGGTKVEIK

SEQ ID NO: 280 - protein, 9 aa, Artificial Sequence
  Description of Artificial Sequence: Synthetic peptide
DSISNYYWS

SEQ ID NO: 281 - protein, 12 aa, Artificial Sequence
  Description of Artificial Sequence: Synthetic peptide
SYIYYSGITNYN

SEQ ID NO: 282 - protein, 14 aa, Artificial Sequence
  Description of Artificial Sequence: Synthetic peptide
CARITVTGFYFDYW

SEQ ID NO: 283 - protein, 12 aa, Artificial Sequence
  Description of Artificial Sequence: Synthetic peptide
RASQSISRSYLA

SEQ ID NO: 284 - protein, 7 aa, Artificial Sequence
  Description of Artificial Sequence: Synthetic peptide
GASSRAT

SEQ ID NO: 285 - protein, 11 aa, Artificial Sequence [sequence omitted]

SEQ ID NO: 286 - protein, 118 aa, Artificial Sequence
  Description of Artificial Sequence: Synthetic polypeptide
QVQLQESGPGLVKPSETLSLTCTVSSDSISNYYWSWIRQPPGKGLEWISYIYYSGITNYNPSLKSRVTISVDTSKNQFSLKLSSVTAADTAVYYCARITVTGFYFDYWGQGTLVTVSS

SEQ ID NO: 287 - protein, 108 aa, Artificial Sequence
  Description of Artificial Sequence: Synthetic polypeptide
EIVLTQSPGTLSLSPGERATLSCRASQSISRSYLAWYQQKPGQAPRHLIYGASSRATGIPDRFSGSGSGTDFILTISRLEPEDFAVYYCQQYDTSPLTFGGGTKVEIK

SEQ ID NO: 288 - protein, 246 aa, Artificial Sequence
  Description of Artificial Sequence: Synthetic polypeptide
QVQLQESGPGLVKPSETLSLTCTVSSDSISNYYWSWIRQPPGKGLEWISYIYYSGITNYNPSLKSRVTISVDTSKNQFSLKLSSVTAADTAVYYCARITVTGFYFDYWGQGTLVTVSSGGGGSGGGGSGGGGSGGGGSEIVLTQSPGTLSLSPGERATLSCRASQSISRSYLAWYQQKPGQAPRHLIYGASSRATGIPDRFSGSGSGTDFILTISRLEPEDFAVYYCQQYDTSPLTFGGGTKVEIK

SEQ ID NO: 289 - protein, 11 aa, Artificial Sequence
  Description of Artificial Sequence: Synthetic peptide
DSVSSNSVVWN

SEQ ID NO: 290 - protein, 14 aa, Artificial Sequence
  Description of Artificial Sequence: Synthetic peptide
GRTYYRSKWYDDYA

SEQ ID NO: 291 - protein, 16 aa, Artificial Sequence
  Description of Artificial Sequence: Synthetic peptide
CARGGIVGAPDAFDIW

SEQ ID NO: 292 - protein, 13 aa, Artificial Sequence
  Description of Artificial Sequence: Synthetic peptide
SGSSSNIGSDPVS

SEQ ID NO: 293 - protein, 7 aa, Artificial Sequence
  Description of Artificial Sequence: Synthetic peptide
TNNQRPS

SEQ ID NO: 294 - protein, 13 aa, Artificial Sequence [sequence omitted]

SEQ ID NO: 295 - protein, 124 aa, Artificial Sequence
  Description of Artificial Sequence: Synthetic polypeptide
QVQLQQSGPGLVKPSQTLSLTCAISGDSVSSNSVVWNWIRQSPSRGLEWLGRTYYRSKWYDDYAVSVKSRITINPDTSKNQFSLQLNSVTPEDTAVYHCARGGIVGAPDAFDIWGQGTMVTVSS

SEQ ID NO: 296 - protein, 110 aa, Artificial Sequence
  Description of Artificial Sequence: Synthetic polypeptide
QSVLTQPPSASGTPGQRVTISCSGSSSNIGSDPVSWYQQFPGTAPKLLIYTNNQRPSGVPDRFSGSKSGTSASLAISGLQSEDEADYYCAAWDDSLNGHVFGTGTKVTVL

SEQ ID NO: 297 - protein, 254 aa, Artificial Sequence
  Description of Artificial Sequence: Synthetic polypeptide
QVQLQQSGPGLVKPSQTLSLTCAISGDSVSSNSVVWNWIRQSPSRGLEWLGRTYYRSKWYDDYAVSVKSRITINPDTSKNQFSLQLNSVTPEDTAVYHCARGGIVGAPDAFDIWGQGTMVTVSSGGGGSGGGGSGGGGSGGGGSQSVLTQPPSASGTPGQRVTISCSGSSSNIGSDPVSWYQQFPGTAPKLLIYTNNQRPSGVPDRFSGSKSGTSASLAISGLQSEDEADYYCAAWDDSLNGHVFGTGTKVTVL

SEQ ID NO: 298 - protein, 11 aa, Artificial Sequence
  Description of Artificial Sequence: Synthetic peptide
DSVSSNSAVWN

SEQ ID NO: 299 - protein, 14 aa, Artificial Sequence
  Description of Artificial Sequence: Synthetic peptide
GWTYYRSKYYNDYA

SEQ ID NO: 300 - protein, 16 aa, Artificial Sequence
  Description of Artificial Sequence: Synthetic peptide
CTRGGIVGAPDGFDIW

SEQ ID NO: 301 - protein, 13 aa, Artificial Sequence
  Description of Artificial Sequence: Synthetic peptide
SGSNSNIGSNPIN

SEQ ID NO: 302 - protein, 7 aa, Artificial Sequence
  Description of Artificial Sequence: Synthetic peptide
SNNQRPS

SEQ ID NO: 303 - protein, 13 aa, Artificial Sequence [sequence omitted]

SEQ ID NO: 304 - protein, 124 aa, Artificial Sequence
  Description of Artificial Sequence: Synthetic polypeptide
QVQLQQSGPGLVKPSQTLSLTCAISGDSVSSNSAVWNWIRQSPSRGLEWLGWTYYRSKYYNDYAVSLKSRITINPDTSKNQFSLQLNSLTPEDTAVYYCTRGGIVGAPDGFDIWGQGTMVTVSS

SEQ ID NO: 305 - protein, 110 aa, Artificial Sequence
  Description of Artificial Sequence: Synthetic polypeptide
QSALTQPPSASGTPGQRVTISCSGSNSNIGSNPINWYQQLPGTAPKLLIYSNNQRPSGVPDRFSGSKSGTSASLAISGLQSEDEADYYCAAWDDSLNGHVFGTGTKVTVL

SEQ ID NO: 306 - protein, 254 aa, Artificial Sequence
  Description of Artificial Sequence: Synthetic polypeptide
QVQLQQSGPGLVKPSQTLSLTCAISGDSVSSNSAVWNWIRQSPSRGLEWLGWTYYRSKYYNDYAVSLKSRITINPDTSKNQFSLQLNSLTPEDTAVYYCTRGGIVGAPDGFDIWGQGTMVTVSSGGGGSGGGGSGGGGSGGGGSQSALTQPPSASGTPGQRVTISCSGSNSNIGSNPINWYQQLPGTAPKLLIYSNNQRPSGVPDRFSGSKSGTSASLAISGLQSEDEADYYCAAWDDSLNGHVFGTGTKVTVL

SEQ ID NO: 307 - protein, 9 aa, Artificial Sequence
  Description of Artificial Sequence: Synthetic peptide
GSISSYYWS

SEQ ID NO: 308 - protein, 12 aa, Artificial Sequence
  Description of Artificial Sequence: Synthetic peptide
GYVYYSDITNYN

SEQ ID NO: 309 - protein, 14 aa, Artificial Sequence
  Description of Artificial Sequence: Synthetic peptide
CARIGVAGFYFDYW

SEQ ID NO: 310 - protein, 12 aa, Artificial Sequence
  Description of Artificial Sequence: Synthetic peptide
RASQSVSRRYLA

SEQ ID NO: 311 - protein, 7 aa, Artificial Sequence
  Description of Artificial Sequence: Synthetic peptide
GASSRAT

SEQ ID NO: 312 - protein, 11 aa, Artificial Sequence [sequence omitted]

SEQ ID NO: 313 - protein, 118 aa, Artificial Sequence
  Description of Artificial Sequence: Synthetic polypeptide
QVQLQESGPGLVKPSETLSLTCTVSGGSISSYYWSWIRQSPGKGLEWIGYVYYSDITNYNPSLKSRVTISVDTSKNQFSLNLNSVTAADTAFYFCARIGVAGFYFDYWGQGTLVTVSS

SEQ ID NO: 314 - protein, 108 aa, Artificial Sequence
  Description of Artificial Sequence: Synthetic polypeptide
EIVLTQSPDTLSLSPGERATLSCRASQSVSRRYLAWYQQKPGQAPRLLIYGASSRATGIPDRFSGSGSGTDFTLTISRLEPEDFEVYYCQQYGTSPITFGQGTRLEIK

SEQ ID NO: 315 - protein, 246 aa, Artificial Sequence
  Description of Artificial Sequence: Synthetic polypeptide
QVQLQESGPGLVKPSETLSLTCTVSGGSISSYYWSWIRQSPGKGLEWIGYVYYSDITNYNPSLKSRVTISVDTSKNQFSLNLNSVTAADTAFYFCARIGVAGFYFDYWGQGTLVTVSSGGGGSGGGGSGGGGSGGGGSEIVLTQSPDTLSLSPGERATLSCRASQSVSRRYLAWYQQKPGQAPRLLIYGASSRATGIPDRFSGSGSGTDFTLTISRLEPEDFEVYYCQQYGTSPITFGQGTRLEIK

SEQ ID NO: 316 - protein, 11 aa, Artificial Sequence
  Description of Artificial Sequence: Synthetic peptide
DSVSSNSAVWN

SEQ ID NO: 317 - protein, 14 aa, Artificial Sequence
  Description of Artificial Sequence: Synthetic peptide
GRTYYRSKWYNDYA

SEQ ID NO: 318 - protein, 16 aa, Artificial Sequence
  Description of Artificial Sequence: Synthetic peptide
FTRGGIVGAPDAFDIW

SEQ ID NO: 319 - protein, 13 aa, Artificial Sequence
  Description of Artificial Sequence: Synthetic peptide
SGSSSNIGSDPIN

SEQ ID NO: 320 - protein, 7 aa, Artificial Sequence
  Description of Artificial Sequence: Synthetic peptide
SNNQRPS

SEQ ID NO: 321 - protein, 13 aa, Artificial Sequence [sequence omitted]

SEQ ID NO: 322 - protein, 124 aa, Artificial Sequence
  Description of Artificial Sequence: Synthetic polypeptide
QIQLQQSGPGLVKPSQTLSLTCAISGDSVSSNSAVWNWIRQSPSRGLEWLGRTYYRSKWYNDYAVSVKSRITIKPDTAKNQFSLQLNSVTPEDTAVYYFTRGGIVGAPDAFDIWGQGTMVTVSS

SEQ ID NO: 323 - protein, 110 aa, Artificial Sequence
  Description of Artificial Sequence: Synthetic polypeptide
QSVLTQPPSASGTPGQRVTISCSGSSSNIGSDPINWYQQVPGTAPKLLIYSNNQRPSGVPDRFSGSKSGTSASLAISGLQSEDEADYYCAAWDDSLNGYVFGTGTKVTVL

SEQ ID NO: 324 - protein, 254 aa, Artificial Sequence
  Description of Artificial Sequence: Synthetic polypeptide
QIQLQQSGPGLVKPSQTLSLTCAISGDSVSSNSAVWNWIRQSPSRGLEWLGRTYYRSKWYNDYAVSVKSRITIKPDTAKNQFSLQLNSVTPEDTAVYYFTRGGIVGAPDAFDIWGQGTMVTVSSGGGGSGGGGSGGGGSGGGGSQSVLTQPPSASGTPGQRVTISCSGSSSNIGSDPINWYQQVPGTAPKLLIYSNNQRPSGVPDRFSGSKSGTSASLAISGLQSEDEADYYCAAWDDSLNGYVFGTGTKVTVL

SEQ ID NO: 325 - protein, 11 aa, Artificial Sequence
  Description of Artificial Sequence: Synthetic peptide
DSVSSNSATWN

SEQ ID NO: 326 - protein, 14 aa, Artificial Sequence
  Description of Artificial Sequence: Synthetic peptide
GRTYYRSEWYNDYA

SEQ ID NO: 327 - protein, 16 aa, Artificial Sequence
  Description of Artificial Sequence: Synthetic peptide
CAGGGIVGAPDGFDVW

SEQ ID NO: 328 - protein, 13 aa, Artificial Sequence
  Description of Artificial Sequence: Synthetic peptide
SGSSSNIGSDPVI

SEQ ID NO: 329 - protein, 7 aa, Artificial Sequence
  Description of Artificial Sequence: Synthetic peptide
SNNQRPS

SEQ ID NO: 330 - protein, 13 aa, Artificial Sequence [sequence omitted]

SEQ ID NO: 331 - protein, 124 aa, Artificial Sequence
  Description of Artificial Sequence: Synthetic polypeptide
QVQLQQSGPGLVKPSETLSLTCAISGDSVSSNSATWNWIRQSPSRGLEWLGRTYYRSEWYNDYAVSVKSRITINPDTSKNHLSLHLNSVTPEDTAVYYCAGGGIVGAPDGFDVWGQGTMVTVSS

SEQ ID NO: 332 - protein, 110 aa, Artificial Sequence
  Description of Artificial Sequence: Synthetic polypeptide
QSVLTQPPSASGTPGQRVTISCSGSSSNIGSDPVIWYQQLPRTAPKLLIYSNNQRPSGVPDRFSGSKSGTSASLAISGLQSEDEADYYCAAWDDSLNGYVFGTGTKVTVL

SEQ ID NO: 333 - protein, 254 aa, Artificial Sequence
  Description of Artificial Sequence: Synthetic polypeptide
QVQLQQSGPGLVKPSETLSLTCAISGDSVSSNSATWNWIRQSPSRGLEWLGRTYYRSEWYNDYAVSVKSRITINPDTSKNHLSLHLNSVTPEDTAVYYCAGGGIVGAPDGFDVWGQGTMVTVSSGGGGSGGGGSGGGGSGGGGSQSVLTQPPSASGTPGQRVTISCSGSSSNIGSDPVIWYQQLPRTAPKLLIYSNNQRPSGVPDRFSGSKSGTSASLAISGLQSEDEADYYCAAWDDSLNGYVFGTGTKVTVL

SEQ ID NO: 334 - protein, 11 aa, Artificial Sequence
  Description of Artificial Sequence: Synthetic peptide
DSVSSNSATWN

SEQ ID NO: 335 - protein, 14 aa, Artificial Sequence
  Description of Artificial Sequence: Synthetic peptide
ARTYYRSKWYNDYE

SEQ ID NO: 336 - protein, 16 aa, Artificial Sequence
  Description of Artificial Sequence: Synthetic peptide
CARGGIVGAPDAFDIW

SEQ ID NO: 337 - protein, 13 aa, Artificial Sequence
  Description of Artificial Sequence: Synthetic peptide
SGSSSNIGSNPVN

SEQ ID NO: 338 - protein, 7 aa, Artificial Sequence
  Description of Artificial Sequence: Synthetic peptide
SNNQRPS

SEQ ID NO: 339 - protein, 13 aa, Artificial Sequence
  Description of Artificial Sequence: Synthetic peptide
CSAWDDWLNGYVF

SEQ ID NO: 340 - protein, 124 aa, Artificial Sequence
  Description of Artificial Sequence: Synthetic polypeptide
QVQLQQSGPGLVKPSQTLSLTCAISGDSVSSNSATWNWIRQSPSTGLEWLARTYYRSKWYNDYEVSVKSQITINPDTSKNQFSLQLNSVTPEDTAVYYCARGGIVGAPDAFDIWGQGTMVTVSS

SEQ ID NO: 341 - protein, 110 aa, Artificial Sequence
  Description of Artificial Sequence: Synthetic polypeptide
QSVLTQPPSASGTPGQGVTISCSGSSSNIGSNPVNWYQQLPGTAPKLLIYSNNQRPSGVPDRFSDSKSGTSASLAISGLQSEDEADYYCSAWDDWLNGYVFGTGTKVTVL

SEQ ID NO: 342 - protein, 254 aa, Artificial Sequence
  Description of Artificial Sequence: Synthetic polypeptide
QVQLQQSGPGLVKPSQTLSLTCAISGDSVSSNSATWNWIRQSPSTGLEWLARTYYRSKWYNDYEVSVKSQITINPDTSKNQFSLQLNSVTPEDTAVYYCARGGIVGAPDAFDIWGQGTMVTVSSGGGGSGGGGSGGGGSGGGGSQSVLTQPPSASGTPGQGVTISCSGSSSNIGSNPVNWYQQLPGTAPKLLIYSNNQRPSGVPDRFSDSKSGTSASLAISGLQSEDEADYYCSAWDDWLNGYVFGTGTKVTVL

SEQ ID NO: 343 - protein, 9 aa, Artificial Sequence
  Description of Artificial Sequence: Synthetic peptide
DSINNYFWS

SEQ ID NO: 344 - protein, 12 aa, Artificial Sequence
  Description of Artificial Sequence: Synthetic peptide
GYFYHRGGNNYN

SEQ ID NO: 345 - protein, 14 aa, Artificial Sequence
  Description of Artificial Sequence: Synthetic peptide
CARLALAGFFFDYW

SEQ ID NO: 346 - protein, 11 aa, Artificial Sequence
  Description of Artificial Sequence: Synthetic peptide
RASQSISSWLA

SEQ ID NO: 347 - protein, 7 aa, Artificial Sequence
  Description of Artificial Sequence: Synthetic peptide
KASSLES

SEQ ID NO: 348 - protein, 11 aa, Artificial Sequence [sequence omitted]

SEQ ID NO: 349 - protein, 118 aa, Artificial Sequence
  Description of Artificial Sequence: Synthetic polypeptide
QVQLQESGPGLVKPSETLSLTCTVSGDSINNYFWSWIRQPPGKGLEWIGYFYHRGGNNYNPSLKSRVTISIDTSKNQFSLNLNSVTSADTAVYYCARLALAGFFFDYWGQGTLVTVSS

SEQ ID NO: 350 - protein, 107 aa, Artificial Sequence
  Description of Artificial Sequence: Synthetic polypeptide
DIQMTQSPSTLSASVGDRVTITCRASQSISSWLAWYQQKPGKAPKLLIYKASSLESGVPSRFSGSGSGTEFTLTISSLQPDDFATYYCQQYNSYSRTFGQGTKVEIK

SEQ ID NO: 351 - protein, 245 aa, Artificial Sequence
  Description of Artificial Sequence: Synthetic polypeptide
QVQLQESGPGLVKPSETLSLTCTVSGDSINNYFWSWIRQPPGKGLEWIGYFYHRGGNNYNPSLKSRVTISIDTSKNQFSLNLNSVTSADTAVYYCARLALAGFFFDYWGQGTLVTVSSGGGGSGGGGSGGGGSGGGGSDIQMTQSPSTLSASVGDRVTITCRASQSISSWLAWYQQKPGKAPKLLIYKASSLESGVPSRFSGSGSGTEFTLTISSLQPDDFATYYCQQYNSYSRTFGQGTKVEIK

SEQ ID NO: 352 - protein, 9 aa, Artificial Sequence
  Description of Artificial Sequence: Synthetic peptide
GTFSTYSIS

SEQ ID NO: 353 - protein, 13 aa, Artificial Sequence
  Description of Artificial Sequence: Synthetic peptide
GGIIPIFGTTNYA

SEQ ID NO: 354 - protein, 18 aa, Artificial Sequence
  Description of Artificial Sequence: Synthetic peptide
CARDGEGSYYYYYGMDVW

SEQ ID NO: 355 - protein, 13 aa, Artificial Sequence
  Description of Artificial Sequence: Synthetic peptide
SGSSSNIGSNYVY

SEQ ID NO: 356 - protein, 7 aa, Artificial Sequence
  Description of Artificial Sequence: Synthetic peptide
SNNQRPS

SEQ ID NO: 357 - protein, 13 aa, Artificial Sequence [sequence omitted]

SEQ ID NO: 358 - protein, 123 aa, Artificial Sequence; identical to SEQ ID NO: 232
  Description of Artificial Sequence: Synthetic polypeptide

SEQ ID NO: 359 - protein, 110 aa, Artificial Sequence
  Description of Artificial Sequence: Synthetic polypeptide
QSVLTQPPSASGTPGQRVTISCSGSSSNIGSNYVYWYQQLPGTAPKLLIYSNNQRPSGVPDRFSGSKSGTSASLAISGLRSEDEADYYCAAWDDSLSGWVFGGGTKLTVL

SEQ ID NO: 360 - protein, 253 aa, Artificial Sequence
  Description of Artificial Sequence: Synthetic polypeptide
QVPLVQSGAEVKKPGSSVKVSCKASGGTFSTYSISWVRQAPGQGLEWMGGIIPIFGTTNYAQKFQGRVTITADKSTSTAYMELSSLRSEDTAVYYCARDGEGSYYYYYGMDVWGQGTTVTVSSGGGGSGGGGSGGGGSGGGGSQSVLTQPPSASGTPGQRVTISCSGSSSNIGSNYVYWYQQLPGTAPKLLIYSNNQRPSGVPDRFSGSKSGTSASLAISGLRSEDEADYYCAAWDDSLSGWVFGGGTKLTVL

SEQ ID NO: 361 - protein, 9 aa, Artificial Sequence
  Description of Artificial Sequence: Synthetic peptide
FTFSSYSMN

SEQ ID NO: 362 - protein, 13 aa, Artificial Sequence
  Description of Artificial Sequence: Synthetic peptide
SYISSSSSTIYYA

SEQ ID NO: 363 - protein, 17 aa, Artificial Sequence
  Description of Artificial Sequence: Synthetic peptide
CARDKERRYYYYGMDVW

SEQ ID NO: 364 - protein, 12 aa, Artificial Sequence
  Description of Artificial Sequence: Synthetic peptide
RASQSVSRRYLA

SEQ ID NO: 365 - protein, 7 aa, Artificial Sequence
  Description of Artificial Sequence: Synthetic peptide
GASSRAT

SEQ ID NO: 366 - protein, 11 aa, Artificial Sequence
  Description of Artificial Sequence: Synthetic peptide
CQQFGTSPITF

SEQ ID NO: 367 - protein, 122 aa, Artificial Sequence
  Description of Artificial Sequence: Synthetic polypeptide
EVQLVESGGGLVQPGGSLRLSCAASGFTFSSYSMNWVRQAPGKGLEWVSYISSSSSTIYYADSVKGRFTISRDNAKNSLYLQMNSLRDEDTAVYYCARDKERRYYYYGMDVWGQGTTVTVSS

SEQ ID NO: 368 - protein, 108 aa, Artificial Sequence
  Description of Artificial Sequence: Synthetic polypeptide
EIVLTQSPDTLSLSPGERATLSCRASQSVSRRYLAWYQQKPGQAPRLLIYGASSRATGIPDRFSGSGSGTDFTLTISRLEPEDFAVYYCQQFGTSPITFGQGTRLEIK

SEQ ID NO: 369 - protein, 250 aa, Artificial Sequence
  Description of Artificial Sequence: Synthetic polypeptide
EVQLVESGGGLVQPGGSLRLSCAASGFTFSSYSMNWVRQAPGKGLEWVSYISSSSSTIYYADSVKGRFTISRDNAKNSLYLQMNSLRDEDTAVYYCARDKERRYYYYGMDVWGQGTTVTVSSGGGGSGGGGSGGGGSGGGGSEIVLTQSPDTLSLSPGERATLSCRASQSVSRRYLAWYQQKPGQAPRLLIYGASSRATGIPDRFSGSGSGTDFTLTISRLEPEDFAVYYCQQFGTSPITFGQGTRLEIK

SEQ ID NO: 370 - protein, 11 aa, Artificial Sequence
  Description of Artificial Sequence: Synthetic peptide
DSVSSNSAIWN

SEQ ID NO: 371 - protein, 14 aa, Artificial Sequence
  Description of Artificial Sequence: Synthetic peptide
GGTYYRSMWYNDYA

SEQ ID NO: 372 - protein, 16 aa, Artificial Sequence
  Description of Artificial Sequence: Synthetic peptide
CSRGGIVGVPDAFDIW

SEQ ID NO: 373 - protein, 13 aa, Artificial Sequence
  Description of Artificial Sequence: Synthetic peptide
SGSSSNIGSNTAN

SEQ ID NO: 374 - protein, 7 aa, Artificial Sequence
  Description of Artificial Sequence: Synthetic peptide
RNNQRPS

SEQ ID NO: 375 - protein, 13 aa, Artificial Sequence [sequence omitted]

SEQ ID NO: 376 - protein, 124 aa, Artificial Sequence
  Description of Artificial Sequence: Synthetic polypeptide
QVQLQQSGPGLVKPSQTLSLACAISGDSVSSNSAIWNWIRQSPSRGLEWLGGTYYRSMWYNDYAVSVKSRITINPDTSKNQLSLQLNSVTPEDTAVYYCSRGGIVGVPDAFDIWGQGTMVTVSS

SEQ ID NO: 377 - protein, 110 aa, Artificial Sequence
  Description of Artificial Sequence: Synthetic polypeptide
QSVLTQPPSASGTPGQRVTISCSGSSSNIGSNTANWYQQLPGTAPRLLIYRNNQRPSGVPDRFSGSKSGTSASLAISGLQSEDEADYYCAAWDDSLNGYVFGTGTKVTVL

SEQ ID NO: 378 - protein, 254 aa, Artificial Sequence
  Description of Artificial Sequence: Synthetic polypeptide
QVQLQQSGPGLVKPSQTLSLACAISGDSVSSNSAIWNWIRQSPSRGLEWLGGTYYRSMWYNDYAVSVKSRITINPDTSKNQLSLQLNSVTPEDTAVYYCSRGGIVGVPDAFDIWGQGTMVTVSSGGGGSGGGGSGGGGSGGGGSQSVLTQPPSASGTPGQRVTISCSGSSSNIGSNTANWYQQLPGTAPRLLIYRNNQRPSGVPDRFSGSKSGTSASLAISGLQSEDEADYYCAAWDDSLNGYVFGTGTKVTVL

SEQ ID NO: 379 - protein, 9 aa, Artificial Sequence
  Description of Artificial Sequence: Synthetic peptide
GSISSYYWT

SEQ ID NO: 380 - protein, 12 aa, Artificial Sequence
  Description of Artificial Sequence: Synthetic peptide
GYIFYSGTTNYN

SEQ ID NO: 381 - protein, 14 aa, Artificial Sequence
  Description of Artificial Sequence: Synthetic peptide
CARISEKSFYFDYW

SEQ ID NO: 382 - protein, 13 aa, Artificial Sequence
  Description of Artificial Sequence: Synthetic peptide
SGSSSNIGSNYVY

SEQ ID NO: 383 - protein, 7 aa, Artificial Sequence
  Description of Artificial Sequence: Synthetic peptide
SNNQRPS

SEQ ID NO: 384 - protein, 13 aa, Artificial Sequence
  Description of Artificial Sequence: Synthetic peptide
CAPWDDSLSGRVF

SEQ ID NO: 385 - protein, 118 aa, Artificial Sequence
  Description of Artificial Sequence: Synthetic polypeptide
QVQLQESGPGLVKPSETLSLTCNVSDGSISSYYWTWIRQPPGKGLDWIGYIFYSGTTNYNPSLKSRVTISLDTSKNQFSLKLTSMTAADTAVYYCARISEKSFYFDYWGQGTLVTVSS

SEQ ID NO: 386 - protein, 110 aa, Artificial Sequence
  Description of Artificial Sequence: Synthetic polypeptide
QSVLTQPPSASGTPGQRVTISCSGSSSNIGSNYVYWYQQLPGTAPKLLIYSNNQRPSGVPDRFSGSKSGTSASLAISGLRSEDEADYYCAPWDDSLSGRVFGGGTKLTVL

SEQ ID NO: 387 - protein, 248 aa, Artificial Sequence
  Description of Artificial Sequence: Synthetic polypeptide
QVQLQESGPGLVKPSETLSLTCNVSDGSISSYYWTWIRQPPGKGLDWIGYIFYSGTTNYNPSLKSRVTISLDTSKNQFSLKLTSMTAADTAVYYCARISEKSFYFDYWGQGTLVTVSSGGGGSGGGGSGGGGSGGGGSQSVLTQPPSASGTPGQRVTISCSGSSSNIGSNYVYWYQQLPGTAPKLLIYSNNQRPSGVPDRFSGSKSGTSASLAISGLRSEDEADYYCAPWDDSLSGRVFGGGTKLTVL

SEQ ID NO: 388 - protein, 9 aa, Artificial Sequence
  Description of Artificial Sequence: Synthetic peptide
YTFTSYYIH

SEQ ID NO: 389 - protein, 13 aa, Artificial Sequence
  Description of Artificial Sequence: Synthetic peptide
GVIVPSGGSISYA

SEQ ID NO: 390 - protein, 17 aa, Artificial Sequence
  Description of Artificial Sequence: Synthetic peptide
CARDRYYGDYYYGLDVW

SEQ ID NO: 391 - protein, 11 aa, Artificial Sequence
  Description of Artificial Sequence: Synthetic peptide
RASQGINNFLA

SEQ ID NO: 392 - protein, 7 aa, Artificial Sequence
  Description of Artificial Sequence: Synthetic peptide
AASSLQS

SEQ ID NO: 393 - protein, 11 aa, Artificial Sequence [sequence omitted]

SEQ ID NO: 394 - protein, 122 aa, Artificial Sequence
  Description of Artificial Sequence: Synthetic polypeptide
QVQLVQSGAEVKRPGASVKVSCKASGYTFTSYYIHWVRQAPGQGLEWMGVIVPSGGSISYAQKFQGRVTMTRDTSTNIVYMELSSLRSEDTAVYYCARDRYYGDYYYGLDVWGQGTTVTVSS

SEQ ID NO: 395 - protein, 107 aa, Artificial Sequence
  Description of Artificial Sequence: Synthetic polypeptide
DIQMTQSPSSLSASVGDRVTITCRASQGINNFLAWFQQKPGKAPKSLIYAASSLQSGVPSKFSGSGSGTDFTLTIRSLQPEDFATYYCQHYNSYPITFGQGTRLEIK

SEQ ID NO: 396 - protein, 249 aa, Artificial Sequence
  Description of Artificial Sequence: Synthetic polypeptide
QVQLVQSGAEVKRPGASVKVSCKASGYTFTSYYIHWVRQAPGQGLEWMGVIVPSGGSISYAQKFQGRVTMTRDTSTNIVYMELSSLRSEDTAVYYCARDRYYGDYYYGLDVWGQGTTVTVSSGGGGSGGGGSGGGGSGGGGSDIQMTQSPSSLSASVGDRVTITCRASQGINNFLAWFQQKPGKAPKSLIYAASSLQSGVPSKFSGSGSGTDFTLTIRSLQPEDFATYYCQHYNSYPITFGQGTRLEIK

SEQ ID NO: 397 - protein, 9 aa, Artificial Sequence
  Description of Artificial Sequence: Synthetic peptide
GSISHYYWT

SEQ ID NO: 398 - protein, 12 aa, Artificial Sequence
  Description of Artificial Sequence: Synthetic peptide
GYIYYSGITNFS

SEQ ID NO: 399 - protein, 14 aa, Artificial Sequence
  Description of Artificial Sequence: Synthetic peptide
CAGISLAGFYFDYW

SEQ ID NO: 400 - protein, 12 aa, Artificial Sequence
  Description of Artificial Sequence: Synthetic peptide
RASQSVSRSYLA

SEQ ID NO: 401 - protein, 7 aa, Artificial Sequence
  Description of Artificial Sequence: Synthetic peptide
GASSRAT

SEQ ID NO: 402 - protein, 11 aa, Artificial Sequence [sequence omitted]

SEQ ID NO: 403 - protein, 118 aa, Artificial Sequence
  Description of Artificial Sequence: Synthetic polypeptide
QVHLQESGPGLVKPSETLSLTCTVSGGSISHYYWTWIRQPPGKGLEWIGYIYYSGITNFSPSLKSRVSISVDSSKNQFSLNLNSVTAADTAVYYCAGISLAGFYFDYWVQGTLVTVSS

SEQ ID NO: 404 - protein, 108 aa, Artificial Sequence
  Description of Artificial Sequence: Synthetic polypeptide
EIVLTQSPGTLSLSPGERATLSCRASQSVSRSYLAWYQQKPGQAPRLLIYGASSRATGVPDRFSGSGSGTDFTLTISRLEPEDFAVFYCQQYSISPLTFGGGTKVEIK

SEQ ID NO: 405 - protein, 246 aa, Artificial Sequence
  Description of Artificial Sequence: Synthetic polypeptide
QVHLQESGPGLVKPSETLSLTCTVSGGSISHYYWTWIRQPPGKGLEWIGYIYYSGITNFSPSLKSRVSISVDSSKNQFSLNLNSVTAADTAVYYCAGISLAGFYFDYWVQGTLVTVSSGGGGSGGGGSGGGGSGGGGSEIVLTQSPGTLSLSPGERATLSCRASQSVSRSYLAWYQQKPGQAPRLLIYGASSRATGVPDRFSGSGSGTDFTLTISRLEPEDFAVFYCQQYSISPLTFGGGTKVEIK

SEQ ID NO: 406 - protein, 9 aa, Artificial Sequence
  Description of Artificial Sequence: Synthetic peptide
VSISSYYWS

SEQ ID NO: 407 - protein, 12 aa, Artificial Sequence
  Description of Artificial Sequence: Synthetic peptide
AYIYYSGNTNYS

SEQ ID NO: 408 - protein, 15 aa, Artificial Sequence
  Description of Artificial Sequence: Synthetic peptide
CTRGGSGTIDVFDIW

SEQ ID NO: 409 - protein, 13 aa, Artificial Sequence
  Description of Artificial Sequence: Synthetic peptide
SGSSSNIGNNYVS

SEQ ID NO: 410 - protein, 7 aa, Artificial Sequence
  Description of Artificial Sequence: Synthetic peptide
DNNKRPS

SEQ ID NO: 411 - protein, 13 aa, Artificial Sequence [sequence omitted]

SEQ ID NO: 412 - protein, 119 aa, Artificial Sequence
  Description of Artificial Sequence: Synthetic polypeptide
QVQLQESGPGLVKPSETLSLTCTVSGVSISSYYWSWIRQPPGKGLEWIAYIYYSGNTNYSPSLKSRVTISVDTSKDQLSLKLSSVTAADTAVYYCTRGGSGTIDVFDIWGQGTMVAVSS

SEQ ID NO: 413 - protein, 110 aa, Artificial Sequence
  Description of Artificial Sequence: Synthetic polypeptide
QSVLTQPPSVSAAPGQKVTISCSGSSSNIGNNYVSWYQQLPGTAPKLLIYDNNKRPSGIPDRFSGSKSGTSATLGITGLQTGDEADYYCETWDSSLSAVVFGGGTKLTVL

SEQ ID NO: 414 - protein, 249 aa, Artificial Sequence
  Description of Artificial Sequence: Synthetic polypeptide
QVQLQESGPGLVKPSETLSLTCTVSGVSISSYYWSWIRQPPGKGLEWIAYIYYSGNTNYSPSLKSRVTISVDTSKDQLSLKLSSVTAADTAVYYCTRGGSGTIDVFDIWGQGTMVAVSSGGGGSGGGGSGGGGSGGGGSQSVLTQPPSVSAAPGQKVTISCSGSSSNIGNNYVSWYQQLPGTAPKLLIYDNNKRPSGIPDRFSGSKSGTSATLGITGLQTGDEADYYCETWDSSLSAVVFGGGTKLTVL

SEQ ID NO: 415 - protein, 11 aa, Artificial Sequence
  Description of Artificial Sequence: Synthetic peptide
DNVSTNSAAWN

SEQ ID NO: 416 - protein, 14 aa, Artificial Sequence
  Description of Artificial Sequence: Synthetic peptide
GWTYYRSKWYNDYA

SEQ ID NO: 417 - protein, 13 aa, Artificial Sequence
  Description of Artificial Sequence: Synthetic peptide
CARWVNRDVFDIW

SEQ ID NO: 418 - protein, 14 aa, Artificial Sequence
  Description of Artificial Sequence: Synthetic peptide
TGTSSDVGSYNLVS

SEQ ID NO: 419 - protein, 7 aa, Artificial Sequence
  Description of Artificial Sequence: Synthetic peptide
EGSKRPS

SEQ ID NO: 420 - protein, 12 aa, Artificial Sequence [sequence omitted]

SEQ ID NO: 421 - protein, 121 aa, Artificial Sequence
  Description of Artificial Sequence: Synthetic polypeptide
QVQLQQSGPGLVKPSQTLSLTCAISGDNVSTNSAAWNWIRQSPSRGLEWLGWTYYRSKWYNDYAVSLKSRININPDTSKNQFSLQLNSVTPEDTAVYYCARWVNRDVFDIWGQGTMVTVSS

SEQ ID NO: 422 - protein, 110 aa, Artificial Sequence
  Description of Artificial Sequence: Synthetic polypeptide
QSALTQPASVSGSPGQSITISCTGTSSDVGSYNLVSWYQQHPGKAPKLMIYEGSKRPSGVSNRFSGSKSGNTASLTISGLQAEDEADYYCCSYAGSSTWVFGGGTKLTVL

SEQ ID NO: 423 - protein, 251 aa, Artificial Sequence
  Description of Artificial Sequence: Synthetic polypeptide
QVQLQQSGPGLVKPSQTLSLTCAISGDNVSTNSAAWNWIRQSPSRGLEWLGWTYYRSKWYNDYAVSLKSRININPDTSKNQFSLQLNSVTPEDTAVYYCARWVNRDVFDIWGQGTMVTVSSGGGGSGGGGSGGGGSGGGGSQSALTQPASVSGSPGQSITISCTGTSSDVGSYNLVSWYQQHPGKAPKLMIYEGSKRPSGVSNRFSGSKSGNTASLTISGLQAEDEADYYCCSYAGSSTWVFGGGTKLTVL

SEQ ID NO: 424 - protein, 9 aa, Artificial Sequence
  Description of Artificial Sequence: Synthetic peptide
FTFSSYGMH

SEQ ID NO: 425 - protein, 13 aa, Artificial Sequence
  Description of Artificial Sequence: Synthetic peptide
AVISYDGNSNYYA

SEQ ID NO: 426 - protein, 19 aa, Artificial Sequence
  Description of Artificial Sequence: Synthetic peptide
CARDGATVTSYYYYGMDVW

SEQ ID NO: 427 - protein, 12 aa, Artificial Sequence
  Description of Artificial Sequence: Synthetic peptide
RASQSVSRTYLA

SEQ ID NO: 428 - protein, 7 aa, Artificial Sequence
  Description of Artificial Sequence: Synthetic peptide
GASSRAT

SEQ ID NO: 429 - protein, 11 aa, Artificial Sequence [sequence omitted]

SEQ ID NO: 430 - protein, 124 aa, Artificial Sequence
  Description of Artificial Sequence: Synthetic polypeptide
QVQLVESGGGVVQPGRSLRLSCAASGFTFSSYGMHWVRQTPGKGLEWVAVISYDGNSNYYADSVKGRFTISRDNSKNTLYLQMNSLRAEDTAVYYCARDGATVTSYYYYGMDVWGQGTTVTVSS

SEQ ID NO: 431 - protein, 108 aa, Artificial Sequence
  Description of Artificial Sequence: Synthetic polypeptide
EIVLTQSPGTLSLSPGERATLSCRASQSVSRTYLAWYHQKPGQAPRLLIYGASSRATGISDRFSGSGSGTDFTLTISRLEPEDFAVYYCQQYGTSPITFGQGTRLEIK

SEQ ID NO: 432 - protein, 252 aa, Artificial Sequence
  Description of Artificial Sequence: Synthetic polypeptide
QVQLVESGGGVVQPGRSLRLSCAASGFTFSSYGMHWVRQTPGKGLEWVAVISYDGNSNYYADSVKGRFTISRDNSKNTLYLQMNSLRAEDTAVYYCARDGATVTSYYYYGMDVWGQGTTVTVSSGGGGSGGGGSGGGGSGGGGSEIVLTQSPGTLSLSPGERATLSCRASQSVSRTYLAWYHQKPGQAPRLLIYGASSRATGISDRFSGSGSGTDFTLTISRLEPEDFAVYYCQQYGTSPITFGQGTRLEIK

SEQ ID NO: 433 - protein, 11 aa, Artificial Sequence
  Description of Artificial Sequence: Synthetic peptide
DSVSSNSAVWN

SEQ ID NO: 434 - protein, 14 aa, Artificial Sequence
  Description of Artificial Sequence: Synthetic peptide
GRTYYRSKWYNDYA

SEQ ID NO: 435 - protein, 16 aa, Artificial Sequence
  Description of Artificial Sequence: Synthetic peptide
CARGGIVGAPDGFDIW

SEQ ID NO: 436 - protein, 17 aa, Artificial Sequence
  Description of Artificial Sequence: Synthetic peptide
KSSQSVLDSSNNNNYFA

SEQ ID NO: 437 - protein, 7 aa, Artificial Sequence
  Description of Artificial Sequence: Synthetic peptide
WASSRES

SEQ ID NO: 438 - protein, 11 aa, Artificial Sequence [sequence omitted]

SEQ ID NO: 439 - protein, 124 aa, Artificial Sequence
  Description of Artificial Sequence: Synthetic polypeptide
QVQLQQSGPGLVKPSQTLSLTCAISGDSVSSNSAVWNWIRQSPSRGLEWLGRTYYRSKWYNDYAVSVKSRITINPDTSRNQFSLQLNSVTPEDTAVYYCARGGIVGAPDGFDIWGQGTMVTVSS

SEQ ID NO: 440 - protein, 113 aa, Artificial Sequence
  Description of Artificial Sequence: Synthetic polypeptide
DIVMTQSPDSLAVSLGERATINCKSSQSVLDSSNNNNYFAWYQQRPGQPPHLLIYWASSRESGVPDRFSGSGSGTDFTLTISSLQAEDVAVYYCQQYYSTPYTFGQGTKLEIK

SEQ ID NO: 441 - protein, 257 aa, Artificial Sequence
  Description of Artificial Sequence: Synthetic polypeptide
QVQLQQSGPGLVKPSQTLSLTCAISGDSVSSNSAVWNWIRQSPSRGLEWLGRTYYRSKWYNDYAVSVKSRITINPDTSRNQFSLQLNSVTPEDTAVYYCARGGIVGAPDGFDIWGQGTMVTVSSGGGGSGGGGSGGGGSGGGGSDIVMTQSPDSLAVSLGERATINCKSSQSVLDSSNNNNYFAWYQQRPGQPPHLLIYWASSRESGVPDRFSGSGSGTDFTLTISSLQAEDVAVYYCQQYYSTPYTFGQGTKLEIK

SEQ ID NO: 442 - protein, 11 aa, Artificial Sequence
  Description of Artificial Sequence: Synthetic peptide
DSVSSNTTAWK

SEQ ID NO: 443 - protein, 14 aa, Artificial Sequence
  Description of Artificial Sequence: Synthetic peptide
GWTYYRSKWYYDYT

SEQ ID NO: 444 - protein, 13 aa, Artificial Sequence
  Description of Artificial Sequence: Synthetic peptide
CARWIFHDAFDIW

SEQ ID NO: 445 - protein, 13 aa, Artificial Sequence
  Description of Artificial Sequence: Synthetic peptide
SGSSSNIGSNTVN

SEQ ID NO: 446 - protein, 7 aa, Artificial Sequence
  Description of Artificial Sequence: Synthetic peptide
TNNQRPS

SEQ ID NO: 447 - protein, 13 aa, Artificial Sequence [sequence omitted]

SEQ ID NO: 448 - protein, 121 aa, Artificial Sequence
  Description of Artificial Sequence: Synthetic polypeptide
QVQLQQSGPGLVKPSQTLSLTCAISGDSVSSNTTAWKWSRQSPSKGLEWLGWTYYRSKWYYDYTVSVKSRITINPDTSKNQFSLQLNSVTPEDTAVYYCARWIFHDAFDIWGQGTMVTVSS

SEQ ID NO: 449 - protein, 110 aa, Artificial Sequence
  Description of Artificial Sequence: Synthetic polypeptide
QSALTQPPSASGTPGQRVTISCSGSSSNIGSNTVNWYQQLPGTAPKLLIYTNNQRPSGVPDRFSGSKSGTSASLAISGLQSEDEADYFCSTWDDSLNGPVFGGGTKLTVL

SEQ ID NO: 450 - protein, 251 aa, Artificial Sequence
  Description of Artificial Sequence: Synthetic polypeptide
QVQLQQSGPGLVKPSQTLSLTCAISGDSVSSNTTAWKWSRQSPSKGLEWLGWTYYRSKWYYDYTVSVKSRITINPDTSKNQFSLQLNSVTPEDTAVYYCARWIFHDAFDIWGQGTMVTVSSGGGGSGGGGSGGGGSGGGGSQSALTQPPSASGTPGQRVTISCSGSSSNIGSNTVNWYQQLPGTAPKLLIYTNNQRPSGVPDRFSGSKSGTSASLAISGLQSEDEADYFCSTWDDSLNGPVFGGGTKLTVL

SEQ ID NO: 451 - protein, 9 aa, Artificial Sequence
  Description of Artificial Sequence: Synthetic peptide
DSISSLSWS

SEQ ID NO: 452 - protein, 12 aa, Artificial Sequence
  Description of Artificial Sequence: Synthetic peptide
GYLYYSGSTDYN

SEQ ID NO: 453 - protein, 11 aa, Artificial Sequence [sequence omitted]

SEQ ID NO: 454 - protein, 11 aa, Artificial Sequence
  Description of Artificial Sequence: Synthetic peptide
RGSQGISNYLA

SEQ ID NO: 455 - protein, 7 aa, Artificial Sequence
  Description of Artificial Sequence: Synthetic peptide
AASSLES

SEQ ID NO: 456 - protein, 11 aa, Artificial Sequence [sequence omitted]

SEQ ID NO: 457 - protein, 115 aa, Artificial Sequence
  Description of Artificial Sequence: Synthetic polypeptide
QVQLQESGPGLVKPSETLSLTCTVSGDSISSLSWSWIRQTPGEGLEWIGYLYYSGSTDYNPSLKSRVTISVDTSKNQFSLKLRSVAAADTALYYCARGRRAFDIWGQGTMVTVSS

SEQ ID NO: 458 - protein, 107 aa, Artificial Sequence
  Description of Artificial Sequence: Synthetic polypeptide
DIQMTQSPSSLSASVGDRVTITCRGSQGISNYLAWFQQRPGKAPKSLIYAASSLESGVPSKFSGSGSGTDFTLTIISLQPEDFATYYCQQYYNYPITFGQGTRLEIK

SEQ ID NO: 459 - protein, 242 aa, Artificial Sequence
  Description of Artificial Sequence: Synthetic polypeptide
QVQLQESGPGLVKPSETLSLTCTVSGDSISSLSWSWIRQTPGEGLEWIGYLYYSGSTDYNPSLKSRVTISVDTSKNQFSLKLRSVAAADTALYYCARGRRAFDIWGQGTMVTVSSGGGGSGGGGSGGGGSGGGGSDIQMTQSPSSLSASVGDRVTITCRGSQGISNYLAWFQQRPGKAPKSLIYAASSLESGVPSKFSGSGSGTDFTLTIISLQPEDFATYYCQQYYNYPITFGQGTRLEIK

SEQ ID NO: 460 - protein, 9 aa, Artificial Sequence
  Description of Artificial Sequence: Synthetic peptide
YTFTGYYMH

SEQ ID NO: 461 - protein, 13 aa, Artificial Sequence
  Description of Artificial Sequence: Synthetic peptide
GWINPNSGGTNYA

SEQ ID NO: 462 - protein, 17 aa, Artificial Sequence
  Description of Artificial Sequence: Synthetic peptide
CAKDGGGDFYFYGMDVW

SEQ ID NO: 463 - protein, 14 aa, Artificial Sequence
  Description of Artificial Sequence: Synthetic peptide
GLSSGSVSTSYYPS

SEQ ID NO: 464 - protein, 7 aa, Artificial Sequence
  Description of Artificial Sequence: Synthetic peptide
STDTRSS

SEQ ID NO: 465 - protein, 12 aa, Artificial Sequence [sequence omitted]

SEQ ID NO: 466 - protein, 122 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSVSTAYMELSRLTSDDTAIYYCAKDGGGDFYFYGMDVWGQGTTVTVSS

SEQ ID NO: 467 - protein, 110 aa, Artificial Sequence
  Description of Artificial Sequence: Synthetic polypeptide
QTVVTQEPSFSVSPGGTVTLTCGLSSGSVSTSYYPSCFQQTPGQAPRTLIYSTDTRSSGVPDRFSGSILGNKAALTITGAQADDESDYYCVLYMGSGISVFGGGTKLTVL

SEQ ID NO: 468 - protein, 252 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSVSTAYMELSRLTSDDTAIYYCAKDGGGDFYFYGMDVWGQGTTVTVSSGGGGSGGGGSGGGGSGGGGSQTVVTQEPSFSVSPGGTVTLTCGLSSGSVSTSYYPSCFQQTPGQAPRTLIYSTDTRSSGVPDRFSGSILGNKAALTITGAQADDESDYYCVLYMGSGISVFGGGTKLTVL

SEQ ID NO: 469 - protein, 113 aa, Artificial Sequence
  Description of Artificial Sequence: Synthetic polypeptide
LRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 470 - protein, 25 aa, Artificial Sequence
  Description of Artificial Sequence: Synthetic peptide
  MISC_FEATURE (1)..(25): This sequence may encompass 1-5 "Gly Gly Gly Gly Ser" repeating units
  See specification as filed for detailed description of substitutions and preferred embodiments
GGGGSGGGGSGGGGSGGGGSGGGGS

SEQ ID NO: 471 - protein, 16 aa, Artificial Sequence
  Description of Artificial Sequence: Synthetic peptide
ELPTQGTFSNVSTNVS

SEQ ID NO: 472 - protein, 15 aa, Artificial Sequence
  Description of Artificial Sequence: Synthetic peptide
GGGGSGGGGSGGGGS

SEQ ID NO: 473 - protein, 8 aa, Artificial Sequence
  Description of Artificial Sequence: Synthetic 8xHis tag
HHHHHHHH

SEQ ID NO: 474 - protein, 571 aa, Artificial Sequence
  Description of Artificial Sequence: Synthetic polypeptide
MALPVTALLLPLALLLHAARPGGGGSCPYSNPSLCSGGGGSGGGGSEVQLLESGGGLVQPGGSLRLSCAASGFTFSSYAMNWVRQAPGKGLEWVSTISGSGGSTYYADSVKGRFTISRDNSKNTLYLQMNSLRAEDTAVFYCAIDPEYYDILTGGDYWGQGTLVTVSSGGGGSGGGGSGGGGGSGGGGSDIQMTQSPSAMSASVGDRVTITCRASQGISNYLAWFQQKPGKVPKRLIYAASSLQSGVPSRFSGSGSGTEFTLTISSLQPEDFATYFCLQHDSFPLTFGGGTKVEIKGSGGGGSCPYSNPSLCSGGGGSELPTQGTFSNVSTNVSPAKPTTTACPYSNPSLCTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 475 - protein, 541 aa, Artificial Sequence
  Description of Artificial Sequence: Synthetic polypeptide
MALPVTALLLPLALLLHAARPEVQLLESGGGLVQPGGSLRLSCAASGFTFSSYAMNWVRQAPGKGLEWVSTISGSGGSTYYADSVKGRFTISRDNSKNTLYLQMNSLRAEDTAVFYCAIDPEYYDILTGGDYWGQGTLVTVSSGGGGSGGGGSGGGGGSGGGGSDIQMTQSPSAMSASVGDRVTITCRASQGISNYLAWFQQKPGKVPKRLIYAASSLQSGVPSRFSGSGSGTEFTLTISSLQPEDFATYFCLQHDSFPLTFGGGTKVEIKGSGGGGSCPYSNPSLCSGGGGSCPYSNPSLCSGGGGSTTTACPYSNPSLCTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 476 - protein, 529 aa, Artificial Sequence
  Description of Artificial Sequence: Synthetic polypeptide
MALPVTALLLPLALLLHAARPGGGGSCPYSNPSLCGGGGSEVQLLESGGGLVQPGGSLRLSCAASGFTFSSYAMNWVRQAPGKGLEWVSTISGSGGSTYYADSVKGRFTISRDNSKNTLYLQMNSLRAEDTAVFYCAIDPEYYDILTGGDYWGQGTLVTVSSGGGGSGGGGSGGGGGSGGGGSDIQMTQSPSAMSASVGDRVTITCRASQGISNYLAWFQQKPGKVPKRLIYAASSLQSGVPSRFSGSGSGTEFTLTISSLQPEDFATYFCLQHDSFPLTFGGGTKVEIKGGGGSCPYSNPSLCGGGGSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 477 - protein, 21 aa, Homo sapiens
MALPVTALLLPLALLLHAARP

SEQ ID NO: 478 - protein, 20 aa, Artificial Sequence
  Description of Artificial Sequence: Synthetic peptide
GGGGSGGGGSGGGGSGGGGS

SEQ ID NO: 479 - protein, 66 aa, Homo sapiens
TTTPAPRPPTPAPTIASQPLSLRPEACRPAAGGAVHTRGLDFACDIYIWAPLAGTCGVLLLSLVIT

SEQ ID NO: 480 - protein, 42 aa, Homo sapiens
KRGRKKLLYIFKQPFMRPVQTTQEEDGCSCRFPEEEEGGCEL

SEQ ID NO: 481 - protein, 113 aa, Homo sapiens
LRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 482 - protein, 486 aa, Artificial Sequence
  Description of Artificial Sequence: Synthetic polypeptide
MALPVTALLLPLALLLHAARPQVQLQESGPGLVKPSETLSLTCTVSDNSISNYYWSWIRQPPGKGLEWIAYIYYSGTTNYNPSLKSRVTISLDTSKNQFSLKLSSVTAADTAVYYCARLFNWGFAFDIWGQGTMVTVSSGGGGSGGGGSGGGGSGGGGSEIVMTQSPATLSVSPGERATLSCRASQSVSSNLAWYQQKPGQAPRLLIYGASTRATGIPARFSGSGSGTEFTLTISSLQSEDFAVYYCQQYNNWPLTFGGGTKVEIKTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 483 - protein, 487 aa, Artificial Sequence
  Description of Artificial Sequence: Synthetic polypeptide
MALPVTALLLPLALLLHAARPQVQLQESGPGLMKPSETLSLTCTVSGGSISSSYWSCIRQPPGKGLEWIGYIYYSGTTNYNPSLKSRVTLSLDTSKNQFSLRLTSVTAADTAVYYCARVAPTGFWFDYWGQGTLVTVSSGGGGSGGGGSGGGGSGGGGSEIVLTQSPGTLSLSPGERATLSCRASQRVSSRYLAWYQQKPGQAPRLLIYGASSRATGIPDRFSGSGSGTDFTLTISRLEPEEFAVYYCQQYGTSPLTFGGGTKVEIKTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 484 - protein, 486 aa, Artificial Sequence
  Description of Artificial Sequence: Synthetic polypeptide
MALPVTALLLPLALLLHAARPEVQLVESGGGLVQPGGSLRLSCAASGFTFSSHDMHWVRQATGKGLEWVSAIGIAGDTYYSGSVKGRFTISRENAKNSLYLQMNSLRAGDTAVYYCARANWGEGAFDIWGQGTMVTVSSGGGGSGGGGSGGGGSGGGGSDIQMTQSPSSLSASVGDRVTITCRASQGISDYLAWYQQKPGKIPKLLIYAASTLQSGVPSRFSGSGSGTDFTLTISSLQPEDVATYYCQKYNSVPLTFGGGTKVEIKTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 485 - protein, 487 aa, Artificial Sequence
  Description of Artificial Sequence: Synthetic polypeptide
MALPVTALLLPLALLLHAARPQVQLQESGPGLVKPSETLSLTCTVSDDSISNYYWSWIRQPPGKGLEWIGYIFYSGTTNHNPSLKSRLTISLDKAKNQFSLRLSSVTAADTAVYYCARVFNWGFAFDIWGQGTMVTVSSGGGGSGGGGSGGGGSGGGGSEIVLTQSPGTLSLSPGERATLSCRASQRISRTYLAWYQQKPGQAPRLLIYGASSRATGIPDRFTGSGSGTDFTLTISRLEPEDFAVYYCQQYGTSPLTFGGGTKVEINTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 486 - protein, 487 aa, Artificial Sequence
  Description of Artificial Sequence: Synthetic polypeptide
MALPVTALLLPLALLLHAARPQVQLQESGPGLVKPSETLSLTCTVSDNSISNYYWSWIRQPPGKGLEWIAYIYYSGTTNYNPSLKSRVTISLDTSKNQFSLQLSSVTAADAAVYYCARVFHWGFAFDIWGQGTMVTVSSGGGGSGGGGSGGGGSGGGGSEIVLTQSPGTLSLSPGERATLSCRASQRVSNTYLAWYQQNPGQAPRLLIYGASSRATGIPDRFSGSGSGTDFTLTISRLEPEDFAVYYCQQYGTSPLTFGGGTKVEIKTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 487 - protein, 487 aa, Artificial Sequence
  Description of Artificial Sequence: Synthetic polypeptide
MALPVTALLLPLALLLHAARPQVQLQESGPGLVKPSETLSLTCTVSNVSISSYYWSWIRQPPGKGLEWIGYIYYSGTTNYNPSLKSRVTMSVDTSKNQFSLKLSSVTAADTAVYFCARLSNWGFAFDIWGQGTMVTFSSGGGGSGGGGSGGGGSGGGGSEIVLTQSPGTLSLSPGERATLSCRASQTISSSYLAWYQQKPGQAPRLLIYGASSRATGIPDRFSGSGSGTEFTLTISRLEPEDFAVYYCQQYGWSPITFGQGTRLEIKTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 488 - protein, 493 aa, Artificial Sequence
  Description of Artificial Sequence: Synthetic polypeptide
MALPVTALLLPLALLLHAARPEVQLVESGGGLVQPGGSLRLSCAASGFTFSSYDMHWVRQATGKGLEWVSAIGPAGDTYYPGSVKGRFTISRENAKNSLYLQMNSLRAGDTAVYYCARADPPYYYYGMDVWGQGTTVTVSSGGGGSGGGGSGGGGSGGGGSDIVMTQSPLSLPVTPGEPASISCRSSQSLLHSNEYNYLDWYLQKPGQSPQLLIYLGSNRASGVPDRFSGSGSGTDFILKISRVEAEDVGVYYCMQALEIPLTFGGGTKVEIKTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 489 - protein, 488 aa, Artificial Sequence
  Description of Artificial Sequence: Synthetic polypeptide
MALPVTALLLPLALLLHAARPQITLKESGPTLVKPTQTLTLTCTFSGFSLSTRGVGVGWIRQPPGKALEWLALIYWNDDKRYSPSLQTRLTITKDTPKNQVVLTMTNMDPVDTATYYCARSNWGNWYFALWGRGTLVTVSSGGGGSGGGGSGGGGSGGGGSEIVLTQSPATLSLSPGERATLSCRASQSVSSYLAWYQQKPGQAPRLLIYDAFYRATGIPARFSGSGSGTDFTLTISSLEPEDFAVYYCQHRSNWPITFGQGTRLEIKTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 490 - protein, 487 aa, Artificial Sequence
  Description of Artificial Sequence: Synthetic polypeptide
MALPVTALLLPLALLLHAARPQVQLQESGPGLVKPSETLSLTCTVSGDSISNYYWTWIRQPPGKGLEWIGYIYYSGTTNSNPSLKSRVTVSLDTSKSQFSLNLSSVTAADTAVYYCARVFNRGFAFDIWGQGTMVTVSSGGGGSGGGGSGGGGSGGGGSEIVLTQSPGTLSLSPGERATLSCRASQRISNTYLAWYQQKPGQAPRLLIYGASSRATGIPDRFSGSGSGTDFTLTISRLEPEDFAAYYCQQYDTSPLTFGGGTKVEIKTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 491 - protein, 496 aa, Artificial Sequence
  Description of Artificial Sequence: Synthetic polypeptide
MALPVTALLLPLALLLHAARPQVTLRESGPALVKPTQTLTLTCTVSGVSLSTSGMCVSWIRQPLGKALEWLGFIDWDDDKYYNTSLKTRLTISKDTSKNQVVLTMTNMDPVDTATYYCARIRGYSGSYDAFDIWGQGTVVIVSSGGGGSGGGGSGGGGSGGGGSDIVMTQSPLSLPVTPGEPASISCRSSQSLLHSNGYNHLDWYLQKPGQSPQVLIYLGSNRASGVPDRFSGSGSGTDFTLKISRVEAEDVGVYFCMQALQTPLTFGGGTKVEIKTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 492 - protein, 486 aa, Artificial Sequence
  Description of Artificial Sequence: Synthetic polypeptide
MALPVTALLLPLALLLHAARPQVQLQVSGPGLVKPSETLSLTCSVSGGSISSYYWSWIRQSPGKGLDWIGYMYYSGTTNYNPSLKSRVTISVDTSKNQFSLKLSSVTATDTAVYYCARVGLTGFFFDYWGQGTLVTVSSGGGGSGGGGSGGGGSGGGGSAIQMTQSPSSLSASVGDRVTITCRASQGIRNDLGWYQQKPGKAPKLLIYAASSLQSGVPSRFSGSGSGTDFTLTVSSLQPEDFATYYCLQDYNYPYTFGQGTKLEIKTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 493 - protein, 483 aa, Artificial Sequence
  Description of Artificial Sequence: Synthetic polypeptide
MALPVTALLLPLALLLHAARPQVQLQQWGGGLLKPSETLSLTCAVYGGSSSGNYWSWIRQPPGKRLEWIGEINHSGTTSYNPSLKSRVTISVDTSKNQFSLKLSSVTAADTAVYYCARGELGIADSWGQGTLVTVSSGGGGSGGGGSGGGGSGGGGSDIQMTQSPSTLSASVGDRVTITCRASQSISRWLAWYQQKPGKAPKLLIYKASSLESGVPSRFSGSGSGTEFTLTISSLQPDDFATYYCQQYNSYSTFGQGTKVEIKTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 494 - protein, 489 aa, Artificial Sequence
  Description of Artificial Sequence: Synthetic polypeptide
MALPVTALLLPLALLLHAARPQLQLQESGPGLVKPSETLSLTCTVSGGSISSSSYYWGWIRQPPGKGLEWIGSIYYSGNIYHNPSLKSRVSISVDTSKNQFSLRLSSVTAADTAVYYCAREIIVGATHFDYWGQGTLVTVSSGGGGSGGGGSGGGGSGGGGSAIQMTQSPSSLSASVGDRVTITCRASQGIRNDLGWYQQKPGKAPELLIYAASSLQSGVPSRFSGSGSGTDFTLTISSLQPEDFATYYCLQDYNYPLTFGPGTKVDIKTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 495 - protein, 487 aa, Artificial Sequence
  Description of Artificial Sequence: Synthetic polypeptide
MALPVTALLLPLALLLHAARPQVQLQQWGAGLLKPSETLSLTCAVYGGSFSGYYWSWIRQPPGKGLEWIGEIIHSGSSNYNPSLKSRVSISVDTSKNQFSLKLSSVTAADTAVYYCSRGEYGSGSRFDYWGQGTLVTVSSGGGGSGGGGSGGGGSGGGGSAIQMTQSPSSLSASVGDRVAITCRASQGIRDDLGWYQQKPGKAPKLLIYAASSLQSGVPSRFSGSRSDTDFTLTISSLQPEDFATYYCLQDYDYPLTFGGGTKVEIKTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 496 - protein, 484 aa, Artificial Sequence
  Description of Artificial Sequence: Synthetic polypeptide
MALPVTALLLPLALLLHAARPQVQLQESGPGLVKPSGTLSLTCAVSGGSISSNNWWSWVRQPPGKGLEWIGDIHHSGSTNYKPSLKSRVTISVDKSKNQFSLNLISVTAADTAVYYCAREAGGYFDYWGQGILVTVSSGGGGSGGGGSGGGGSGGGGSDIQMTQSPSTLSASVGDRVTITCRASQSISSWLAWYQQKPGKAPKLLISKASSLESGVPSRFSGSGSGPEFTLTISSLQPADFATYYCQQYNSYSTFGQGTKLEIKTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 497 - protein, 487 aa, Artificial Sequence
  Description of Artificial Sequence: Synthetic polypeptide
MALPVTALLLPLALLLHAARPQVQLQQWGAGLLKPSETLSLTCAVYGGSFSGYYWTWIRQPPGKGLEWIGEITHSGSTNYNPSLKSRVSISVDTSKNQFSLKLSSVTAADTAVYYCARGEYGSGSRFDYWGQGTLVTVSSGGGGSGGGGSGGGGSGGGGSAIQMTQSPSSLSASVGDRVAITCRASQGIRDDLGWYQQKPGKAPKLLIYAASSLQSGVPSRFSGSGSDTDFTLTISSLQPEDFATYYCLQDYDYPLTFGGGTKVEIKTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 498 - protein, 487 aa, Artificial Sequence
  Description of Artificial Sequence: Synthetic polypeptide
MALPVTALLLPLALLLHAARPQVQLQQWGAGLLKPSETLSLTCAVYGGSFSGYYWSWIRQPPGKGLEWIGEITHSGSTNYNPSLKSRVSISVDTSKNQFSLKLSSVTAADTAVYYCARGEYGSGSRFDYWGQGTLVTVSSGGGGSGGGGSGGGGSGGGGSAIQMTQSPSSLSASVGDRVALTCRASQGIRDDLGWYQQKPGKAPKLLIYAASSLQSGVPSRFSGSGSDTDFTLTISSLQPEDFATYYCLQDYDYPLTFGGGTKVEIKTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 499 - protein, 488 aa, Artificial Sequence
  Description of Artificial Sequence: Synthetic polypeptide
MALPVTALLLPLALLLHAARPQVQLQQWGAGLLKPSETLSLTCAVYGGSFSAYYWNWIRQPPGKGLEWIGEINHSGSTNYNPSLKSRVTISVDTSKNQFSLNLTSLTAADTAVYYCARGLDSSGWYPFDYWGQGTLVTVSSGGGGSGGGGSGGGGSGGGGSDIQMTQSPSSVSASVGDRVTITCRASQGISSWLAWYQQKPGKAPKLLIYAASSLQSGVPSRFSGSGSGTDFTLTISSLQPEDFATYYCQQADSFPFTFGPGTKVDIKTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 500 - protein, 483 aa, Artificial Sequence
  Description of Artificial Sequence: Synthetic polypeptide
MALPVTALLLPLALLLHAARPQVQLQQWGAGLLKPSETLSLTCAVFGGSFSGDYWSWIRQPPGKGLEWIGEINHSGITSFNPSLKSRVTISVDTSKNQFSLKLSSVTAADTAVYYCARGELGIPDNWGQGTLVTVSSGGGGSGGGGSGGGGSGGGGSDIQMTQSPSTLSASVGDRVTITCRASQSISRWLAWYQQKPGKAPKLLIYKASSLESGVPSRFSGSGSGTEFTLTISSLQPDDFATYYCQQYNSYSTFGQGTKVEIKTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 501 - protein, 492 aa, Artificial Sequence
  Description of Artificial Sequence: Synthetic polypeptide
MALPVTALLLPLALLLHAARPQVQLQESGPGLVKPSGTLSLTCVVFGDSISSSNWWSWVRQPPGKGLEWIGEVFHSGSTNYNPSLKSRVTISVDKSKNQFSLKLSSVTAADTAVYYCARAAVAGALDYWGQGTLVTVSSGGGGSGGGGSGGGGSGGGGSDIVMTQSPDSLAVSLGERATINCKSSQSVLYSSNNKNYLAWYQQKPGQPPNLLVYWASTRESGVPDRFSGAGSGTDFTLTISSLQAEDVAVYYCQQYYGTSWTFGQGTKVEIKTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 502 - protein, 488 aa, Artificial Sequence
  Description of Artificial Sequence: Synthetic polypeptide
MALPVTALLLPLALLLHAARPQITLRESGPTLVKPTQTLTLTCTFSGFSLSTSGLGVGWIRQPPGEALEWLALIYWNDDKRYSPSLKSRLSITKDTSKNQVVLIMTNMDPVDTATYYCVHRRIAAPGSVYWGQGTLVTVSSGGGGSGGGGSGGGGSGGGGSDIQMTQSPSSVSASVGDRVTITCRASQGISSWLAWYQQKPGKAPKLLISAASSLQSGVPSRFSGSGSGTDFTLTISSLQPEDFATYYCHQANSFPFTFGQGTKLEIKTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 503 - protein, 487 aa, Artificial Sequence
  Description of Artificial Sequence: Synthetic polypeptide
MALPVTALLLPLALLLHAARPQVQLVQSGAEVKKPGASVKVSCKVSGYTLTELSMHWVRQAPGKGPEGMGGFDPEDGKTIYAQKFQGRVTMTEDTSADTAYMELNSLRSEDTAVYYCATLLRGLDAFDVWGQGTMVTVSSGGGGSGGGGSGGGGSGGGGSDIQMTQSPSSLSASVGDRVTITCRASQGIRNDLGWYQQKPGKAPKRLIYAASSLQSGVPSRFSGSGSGTEFTLTISTLQPEDFATYYCLQHNSYPRTFGQGTKVEIKTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 504 - protein, 488 aa, Artificial Sequence
  Description of Artificial Sequence: Synthetic polypeptide
MALPVTALLLPLALLLHAARPQVQLQQWGAGLLKPSETLSLTCAVYGGSFSGYYWRWIRQPPGKGLEWIGEISHSGSTNYNPSLKSRVTISVDTSKNQFSLKLSSVTAADTAVYYCAVRGYSYGYPLFDYWGQGTLVTVSSGGGGSGGGGSGGGGSGGGGSDIQMTQSPSSLSASVGDRVTITCRASQGIRNDLGWYQQKLGKAPKRLIYAASSLQSGVPSRFSGSGSGTEFTLTISSLQPEDFATYYCLQYNSYPRTFGQGTKVEIKTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 505 - protein, 483 aa, Artificial Sequence
  Description of Artificial Sequence: Synthetic polypeptide
MALPVTALLLPLALLLHAARPQVQLQESGPGLVKPSGTLSLTCAVSGDSISSNWWTWVRQPPGKGLEWIGDIHHSGSTNYNPSLKSRVTMSVDKSENQFSLKLSSVTAADTAVFYCARDGGGTLDYWGQGTLVTVSSGGGGSGGGGSGGGGSGGGGSDIQMTQSPSTLSASVGDRVTITCRASQSISSWLAWYQQKPGKAPKLLIYKASTLESGVPSRFSGSGSGTEFTLTISSLQPDDFATYYCQQYNGYSTFGQGTKVEIKTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 506 - protein, 492 aa, Artificial Sequence
  Description of Artificial Sequence: Synthetic polypeptide
MALPVTALLLPLALLLHAARPQVQLVQSGAEVKKPGSSVKVSCKASGGTFTNYCISWVRQAPGQGLEWMGGIIPIFGTTNYAQTFQGRVTITADKSTSTAYMELSSLRSEDTAVYYCARDNGDRYYYDMDVWGQGTTVTVSSGGGGSGGGGSGGGGSGGGGSQSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAVVFGGGTKLTVLTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 507 - protein, 494 aa, Artificial Sequence
  Description of Artificial Sequence: Synthetic polypeptide
MALPVTALLLPLALLLHAARPQVPLVQSGAEVKKPGSSVKVSCKASGGTFSTYSISWVRQAPGQGLEWMGGIIPIFGTTNYAQKFQGRVTITADKSTSTAYMELSSLRSEDTAVYYCARDGEGSYYYYYGMDVWGQGTTVTVSSGGGGSGGGGSGGGGSGGGGSQSVLTQPPSVSAAPGQKVTISCSGSSSNIGNNYVSWYQQLPGTAPKLLIYDNNKRPSGIPDRFFGSKFGTSATLGITGLQTGDEADYYCGTWDSSLSAVVFGGGTKLTVLTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 508 - protein, 487 aa, Artificial Sequence
  Description of Artificial Sequence: Synthetic polypeptide
MALPVTALLLPLALLLHAARPQVQLQESGPGLVKPSETLSLTCTVSGDSISSYYWSWIRQPPGKGLEWIGYMYYSGITNYNPSLKSRVNISLDTSKNQFSLKLGSVTAADTAVYYCARLSVAGFYFDYWGQGTLVTVSSGGGGSGGGGSGGGGSGGGGSEIVLTQSPGTLSLSPGERATLSCRASQSVTRSYLAWYQQKPGQAPRLLIYGASSRATDIPDRFSGSGSGTDFTLTINRLEPEDFAVYYCQQYGTSPLTFGGGTKVEIKTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 509 - protein, 487 aa, Artificial Sequence
  Description of Artificial Sequence: Synthetic polypeptide
MALPVTALLLPLALLLHAARPQVQLQESGPGLVKPSETLSLTCTVSSDSISSYYWSWIRQPPGKGLEWISYIYYSGISNYNPSLKSRVSISVDTSKNQFSLRLSSVTAADTAVYYCARISVAGFFFDNWGQGTLVTVSSGGGGSGGGGSGGGGSGGGGSEIMLTQSPDTLSLSPGERATLSCRASQSVSSSYLAWYQQKPGQAPRLLIYGASSRAAGVPDRFSGSGSGTDFTLTISRLAPEDFVVYYCQQYGISPLTFGGGTKVEIKTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 510 - protein, 495 aa, Artificial Sequence
  Description of Artificial Sequence: Synthetic polypeptide
MALPVTALLLPLALLLHAARPQVQLQQSGPGLVKPSQTLSLTCAISGDSVSSNSATWNWIRQSPSRGLEWLGRTYYRSKWYDDYAVSVKSRITINPDTSKNHLSLHLNSVTPEDTAVYYCAGGGLVGAPDGFDVWGQGTMVTVSSGGGGSGGGGSGGGGSGGGGSQSVLTQPPSASGTPGQRVTISCSGSSSNIGSDPVNWYQQLPGTAPKLLIYSNNQRPSGVPDRFSGSKSGTSASLAISGLQSEDEADYYCSAWDDSLNGYVFGTGTKVTVLTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 511 - protein, 490 aa, Artificial Sequence
  Description of Artificial Sequence: Synthetic polypeptide
MALPVTALLLPLALLLHAARPQVQLVQSGAEVKKPGASVKVSCKASGYTFTGYSIHWVRQAPGQGLEWMGWINPNSGGTFYAQKFQGRVTMTRDTSISTVYMELSRLRSDDTAVYYCARDGWGDYYYYGLDVWGQGTTVTVSLGGGGSGGGGSGGGGSGGGGSDIQMTQSPSSVSASVGDRVTITCRASQDISSWLAWYQQKPGKAPKLLIYTASSLQGGVPSRFSGSGSGTDFTLTISSLQPEDLATYSCQQANVFPYTFGQGTKLEIKTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 512 - protein, 491 aa, Artificial Sequence
  Description of Artificial Sequence: Synthetic polypeptide
MALPVTALLLPLALLLHAARPEVQLLESGGGLVQPGGSLRLSCAASGFTFSSYAMNWVRQAPGKGLEWVSTISGSGGSTYYADSVKGRFTISRDNSKNTLYLQMNSLRAEDTAVFYCAIDPEYYDILTGGDYWGQGTLVTVSSGGGGSGGGGSGGGGGSGGGGSDIQMTQSPSAMSASVGDRVTITCRASQGISNYLAWFQQKPGKVPKRLIYAASSLQSGVPSRFSGSGSGTEFTLTISSLQPEDFATYFCLQHDSFPLTFGGGTKVEIKTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 513 - protein, 487 aa, Artificial Sequence
  Description of Artificial Sequence: Synthetic polypeptide
MALPVTALLLPLALLLHAARPQVQLQESGPGLVKPSETLSLTCTVSSDSISNYYWSWIRQPPGKGLEWISYIYYSGITNYNPSLKSRVTISVDTSKNQFSLKLSSVTAADTAVYYCARITVTGFYFDYWGQGTLVTVSSGGGGSGGGGSGGGGSGGGGSEIVLTQSPGTLSLSPGERATLSCRASQSISRSYLAWYQQKPGQAPRHLIYGASSRATGIPDRFSGSGSGTDFILTISRLEPEDFAVYYCQQYDTSPLTFGGGTKVEIKTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 514 - protein, 495 aa, Artificial Sequence
  Description of Artificial Sequence: Synthetic polypeptide
MALPVTALLLPLALLLHAARPQVQLQQSGPGLVKPSQTLSLTCAISGDSVSSNSVVWNWIRQSPSRGLEWLGRTYYRSKWYDDYAVSVKSRITINPDTSKNQFSLQLNSVTPEDTAVYHCARGGIVGAPDAFDIWGQGTMVTVSSGGGGSGGGGSGGGGSGGGGSQSVLTQPPSASGTPGQRVTISCSGSSSNIGSDPVSWYQQFPGTAPKLLIYTNNQRPSGVPDRFSGSKSGTSASLAISGLQSEDEADYYCAAWDDSLNGHVFGTGTKVTVLTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 515 - protein, 495 aa, Artificial Sequence
  Description of Artificial Sequence: Synthetic polypeptide
MALPVTALLLPLALLLHAARPQVQLQQSGPGLVKPSQTLSLTCAISGDSVSSNSAVWNWIRQSPSRGLEWLGWTYYRSKYYNDYAVSLKSRITINPDTSKNQFSLQLNSLTPEDTAVYYCTRGGIVGAPDGFDIWGQGTMVTVSSGGGGSGGGGSGGGGSGGGGSQSALTQPPSASGTPGQRVTISCSGSNSNIGSNPINWYQQLPGTAPKLLIYSNNQRPSGVPDRFSGSKSGTSASLAISGLQSEDEADYYCAAWDDSLNGHVFGTGTKVTVLTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 516 - protein, 487 aa, Artificial Sequence
  Description of Artificial Sequence: Synthetic polypeptide
MALPVTALLLPLALLLHAARPQVQLQESGPGLVKPSETLSLTCTVSGGSISSYYWSWIRQSPGKGLEWIGYVYYSDITNYNPSLKSRVTISVDTSKNQFSLNLNSVTAADTAFYFCARIGVAGFYFDYWGQGTLVTVSSGGGGSGGGGSGGGGSGGGGSEIVLTQSPDTLSLSPGERATLSCRASQSVSRRYLAWYQQKPGQAPRLLIYGASSRATGIPDRFSGSGSGTDFTLTISRLEPEDFEVYYCQQYGTSPITFGQGTRLEIKTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 517 - protein, 495 aa, Artificial Sequence
  Description of Artificial Sequence: Synthetic polypeptide
MALPVTALLLPLALLLHAARPQIQLQQSGPGLVKPSQTLSLTCAISGDSVSSNSAVWNWIRQSPSRGLEWLGRTYYRSKWYNDYAVSVKSRITIKPDTAKNQFSLQLNSVTPEDTAVYYFTRGGIVGAPDAFDIWGQGTMVTVSSGGGGSGGGGSGGGGSGGGGSQSVLTQPPSASGTPGQRVTISCSGSSSNIGSDPINWYQQVPGTAPKLLIYSNNQRPSGVPDRFSGSKSGTSASLAISGLQSEDEADYYCAAWDDSLNGYVFGTGTKVTVLTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 518 - protein, 495 aa, Artificial Sequence
  Description of Artificial Sequence: Synthetic polypeptide
MALPVTALLLPLALLLHAARPQVQLQQSGPGLVKPSETLSLTCAISGDSVSSNSATWNWIRQSPSRGLEWLGRTYYRSEWYNDYAVSVKSRITINPDTSKNHLSLHLNSVTPEDTAVYYCAGGGIVGAPDGFDVWGQGTMVTVSSGGGGSGGGGSGGGGSGGGGSQSVLTQPPSASGTPGQRVTISCSGSSSNIGSDPVIWYQQLPRTAPKLLIYSNNQRPSGVPDRFSGSKSGTSASLAISGLQSEDEADYYCAAWDDSLNGYVFGTGTKVTVLTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 519 - protein, 495 aa, Artificial Sequence
  Description of Artificial Sequence: Synthetic polypeptide
MALPVTALLLPLALLLHAARPQVQLQQSGPGLVKPSQTLSLTCAISGDSVSSNSATWNWIRQSPSTGLEWLARTYYRSKWYNDYEVSVKSQITINPDTSKNQFSLQLNSVTPEDTAVYYCARGGIVGAPDAFDIWGQGTMVTVSSGGGGSGGGGSGGGGSGGGGSQSVLTQPPSASGTPGQGVTISCSGSSSNIGSNPVNWYQQLPGTAPKLLIYSNNQRPSGVPDRFSDSKSGTSASLAISGLQSEDEADYYCSAWDDWLNGYVFGTGTKVTVLTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 520 - protein, 486 aa, Artificial Sequence
  Description of Artificial Sequence: Synthetic polypeptide
MALPVTALLLPLALLLHAARPQVQLQESGPGLVKPSETLSLTCTVSGDSINNYFWSWIRQPPGKGLEWIGYFYHRGGNNYNPSLKSRVTISIDTSKNQFSLNLNSVTSADTAVYYCARLALAGFFFDYWGQGTLVTVSSGGGGSGGGGSGGGGSGGGGSDIQMTQSPSTLSASVGDRVTITCRASQSISSWLAWYQQKPGKAPKLLIYKASSLESGVPSRFSGSGSGTEFTLTISSLQPDDFATYYCQQYNSYSRTFGQGTKVEIKTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 521 - protein, 494 aa, Artificial Sequence
  Description of Artificial Sequence: Synthetic polypeptide
MALPVTALLLPLALLLHAARPQVPLVQSGAEVKKPGSSVKVSCKASGGTFSTYSISWVRQAPGQGLEWMGGIIPIFGTTNYAQKFQGRVTITADKSTSTAYMELSSLRSEDTAVYYCARDGEGSYYYYYGMDVWGQGTTVTVSSGGGGSGGGGSGGGGSGGGGSQSVLTQPPSASGTPGQRVTISCSGSSSNIGSNYVYWYQQLPGTAPKLLIYSNNQRPSGVPDRFSGSKSGTSASLAISGLRSEDEADYYCAAWDDSLSGWVFGGGTKLTVLTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 522 - protein, 491 aa, Artificial Sequence
  Description of Artificial Sequence: Synthetic polypeptide
MALPVTALLLPLALLLHAARPEVQLVESGGGLVQPGGSLRLSCAASGFTFSSYSMNWVRQAPGKGLEWVSYISSSSSTIYYADSVKGRFTISRDNAKNSLYLQMNSLRDEDTAVYYCARDKERRYYYYGMDVWGQGTTVTVSSGGGGSGGGGSGGGGSGGGGSEIVLTQSPDTLSLSPGERATLSCRASQSVSRRYLAWYQQKPGQAPRLLIYGASSRATGIPDRFSGSGSGTDFTLTISRLEPEDFAVYYCQQFGTSPITFGQGTRLEIKTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 523 - protein, 495 aa, Artificial Sequence
  Description of Artificial Sequence: Synthetic polypeptide
MALPVTALLLPLALLLHAARPQVQLQQSGPGLVKPSQTLSLACAISGDSVSSNSAIWNWIRQSPSRGLEWLGGTYYRSMWYNDYAVSVKSRITINPDTSKNQLSLQLNSVTPEDTAVYYCSRGGIVGVPDAFDIWGQGTMVTVSSGGGGSGGGGSGGGGSGGGGSQSVLTQPPSASGTPGQRVTISCSGSSSNIGSNTANWYQQLPGTAPRLLIYRNNQRPSGVPDRFSGSKSGTSASLAISGLQSEDEADYYCAAWDDSLNGYVFGTGTKVTVLTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 524 - protein, 489 aa, Artificial Sequence
  Description of Artificial Sequence: Synthetic polypeptide
MALPVTALLLPLALLLHAARPQVQLQESGPGLVKPSETLSLTCNVSDGSISSYYWTWIRQPPGKGLDWIGYIFYSGTTNYNPSLKSRVTISLDTSKNQFSLKLTSMTAADTAVYYCARISEKSFYFDYWGQGTLVTVSSGGGGSGGGGSGGGGSGGGGSQSVLTQPPSASGTPGQRVTISCSGSSSNIGSNYVYWYQQLPGTAPKLLIYSNNQRPSGVPDRFSGSKSGTSASLAISGLRSEDEADYYCAPWDDSLSGRVFGGGTKLTVLTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 525 - protein, 490 aa, Artificial Sequence
  Description of Artificial Sequence: Synthetic polypeptide
MALPVTALLLPLALLLHAARPQVQLVQSGAEVKRPGASVKVSCKASGYTFTSYYIHWVRQAPGQGLEWMGVIVPSGGSISYAQKFQGRVTMTRDTSTNIVYMELSSLRSEDTAVYYCARDRYYGDYYYGLDVWGQGTTVTVSSGGGGSGGGGSGGGGSGGGGSDIQMTQSPSSLSASVGDRVTITCRASQGINNFLAWFQQKPGKAPKSLIYAASSLQSGVPSKFSGSGSGTDFTLTIRSLQPEDFATYYCQHYNSYPITFGQGTRLEIKTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 526 - protein, 487 aa, Artificial Sequence
  Description of Artificial Sequence: Synthetic polypeptide
MALPVTALLLPLALLLHAARPQVHLQESGPGLVKPSETLSLTCTVSGGSISHYYWTWIRQPPGKGLEWIGYIYYSGITNFSPSLKSRVSISVDSSKNQFSLNLNSVTAADTAVYYCAGISLAGFYFDYWVQGTLVTVSSGGGGSGGGGSGGGGSGGGGSEIVLTQSPGTLSLSPGERATLSCRASQSVSRSYLAWYQQKPGQAPRLLIYGASSRATGVPDRFSGSGSGTDFTLTISRLEPEDFAVFYCQQYSISPLTFGGGTKVEIKTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 527 - protein, 490 aa, Artificial Sequence
  Description of Artificial Sequence: Synthetic polypeptide
MALPVTALLLPLALLLHAARPQVQLQESGPGLVKPSETLSLTCTVSGVSISSYYWSWIRQPPGKGLEWIAYIYYSGNTNYSPSLKSRVTISVDTSKDQLSLKLSSVTAADTAVYYCTRGGSGTIDVFDIWGQGTMVAVSSGGGGSGGGGSGGGGSGGGGSQSVLTQPPSVSAAPGQKVTISCSGSSSNIGNNYVSWYQQLPGTAPKLLIYDNNKRPSGIPDRFSGSKSGTSATLGITGLQTGDEADYYCETWDSSLSAVVFGGGTKLTVLTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 528 - protein, 492 aa, Artificial Sequence
  Description of Artificial Sequence: Synthetic polypeptide
MALPVTALLLPLALLLHAARPQVQLQQSGPGLVKPSQTLSLTCAISGDNVSTNSAAWNWIRQSPSRGLEWLGWTYYRSKWYNDYAVSLKSRININPDTSKNQFSLQLNSVTPEDTAVYYCARWVNRDVFDIWGQGTMVTVSSGGGGSGGGGSGGGGSGGGGSQSALTQPASVSGSPGQSITISCTGTSSDVGSYNLVSWYQQHPGKAPKLMIYEGSKRPSGVSNRFSGSKSGNTASLTISGLQAEDEADYYCCSYAGSSTWVFGGGTKLTVLTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 529 - protein, 493 aa, Artificial Sequence
  Description of Artificial Sequence: Synthetic polypeptide
MALPVTALLLPLALLLHAARPQVQLVESGGGVVQPGRSLRLSCAASGFTFSSYGMHWVRQTPGKGLEWVAVISYDGNSNYYADSVKGRFTISRDNSKNTLYLQMNSLRAEDTAVYYCARDGATVTSYYYYGMDVWGQGTTVTVSSGGGGSGGGGSGGGGSGGGGSEIVLTQSPGTLSLSPGERATLSCRASQSVSRTYLAWYHQKPGQAPRLLIYGASSRATGISDRFSGSGSGTDFTLTISRLEPEDFAVYYCQQYGTSPITFGQGTRLEIKTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 530 - protein, 498 aa, Artificial Sequence
  Description of Artificial Sequence: Synthetic polypeptide
MALPVTALLLPLALLLHAARPQVQLQQSGPGLVKPSQTLSLTCAISGDSVSSNSAVWNWIRQSPSRGLEWLGRTYYRSKWYNDYAVSVKSRITINPDTSRNQFSLQLNSVTPEDTAVYYCARGGIVGAPDGFDIWGQGTMVTVSSGGGGSGGGGSGGGGSGGGGSDIVMTQSPDSLAVSLGERATINCKSSQSVLDSSNNNNYFAWYQQRPGQPPHLLIYWASSRESGVPDRFSGSGSGTDFTLTISSLQAEDVAVYYCQQYYSTPYTFGQGTKLEIKTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 531 - protein, 492 aa, Artificial Sequence
  Description of Artificial Sequence: Synthetic polypeptide
MALPVTALLLPLALLLHAARPQVQLQQSGPGLVKPSQTLSLTCAISGDSVSSNTTAWKWSRQSPSKGLEWLGWTYYRSKWYYDYTVSVKSRITINPDTSKNQFSLQLNSVTPEDTAVYYCARWIFHDAFDIWGQGTMVTVSSGGGGSGGGGSGGGGSGGGGSQSALTQPPSASGTPGQRVTISCSGSSSNIGSNTVNWYQQLPGTAPKLLIYTNNQRPSGVPDRFSGSKSGTSASLAISGLQSEDEADYFCSTWDDSLNGPVFGGGTKLTVLTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 532 - protein, 483 aa, Artificial Sequence
  Description of Artificial Sequence: Synthetic polypeptide
MALPVTALLLPLALLLHAARPQVQLQESGPGLVKPSETLSLTCTVSGDSISSLSWSWIRQTPGEGLEWIGYLYYSGSTDYNPSLKSRVTISVDTSKNQFSLKLRSVAAADTALYYCARGRRAFDIWGQGTMVTVSSGGGGSGGGGSGGGGSGGGGSDIQMTQSPSSLSASVGDRVTITCRGSQGISNYLAWFQQRPGKAPKSLIYAASSLESGVPSKFSGSGSGTDFTLTIISLQPEDFATYYCQQYYNYPITFGQGTRLEIKTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 533 - protein, 493 aa, Artificial Sequence
  Description of Artificial Sequence: Synthetic polypeptide
MALPVTALLLPLALLLHAARPQVQLVQSGAEVKKPGASVKVSCKASGYTFTGYYMHWVRQAPGQGLEWMGWINPNSGGTNYAQKFQGRVTMTRDTSVSTAYMELSRLTSDDTAIYYCAKDGGGDFYFYGMDVWGQGTTVTVSSGGGGSGGGGSGGGGSGGGGSQTVVTQEPSFSVSPGGTVTLTCGLSSGSVSTSYYPSCFQQTPGQAPRTLIYSTDTRSSGVPDRFSGSILGNKAALTITGAQADDESDYYCVLYMGSGISVFGGGTKLTVLTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 534 - protein, 15 aa, Artificial Sequence
  Description of Artificial Sequence: Synthetic peptide
GGGGSGGGGSGGGGS

SEQ ID NO: 535 - protein, 18 aa, Artificial Sequence
  Description of Artificial Sequence: Synthetic peptide
GSTSGSGKPGSGEGSTKG

SEQ ID NO: 536 - protein, 9 aa, Artificial Sequence
  Description of Artificial Sequence: Synthetic peptide
CPYSNPSLC

SEQ ID NO: 537 - protein, 24 aa, Artificial Sequence
  Description of Artificial Sequence: Synthetic peptide
NSELLSLINDMPITNDQKKLMSNN

SEQ ID NO: 538 - protein, 12 aa, Artificial Sequence
  Description of Artificial Sequence: Synthetic peptide
CQFDLSTRRLKC

SEQ ID NO: 539 - protein, 12 aa, Artificial Sequence
  Description of Artificial Sequence: Synthetic peptide
CQYNLSSRALKC

SEQ ID NO: 540 - protein, 12 aa, Artificial Sequence
  Description of Artificial Sequence: Synthetic peptide
CVWQRWQKSYVC

SEQ ID NO: 541 - protein, 12 aa, Artificial Sequence
  Description of Artificial Sequence: Synthetic peptide
CMWDRFSRWYKC

SEQ ID NO: 542 - protein, 25 aa, Artificial Sequence
  Description of Artificial Sequence: Synthetic peptide
SFVLNWYRMSPSNQTDKLAAFPEDR

SEQ ID NO: 543 - protein, 19 aa, Artificial Sequence
  Description of Artificial Sequence: Synthetic peptide
SGTYLCGAISLAPKAQIKE

SEQ ID NO: 544 - protein, 24 aa, Artificial Sequence
  Description of Artificial Sequence: Synthetic peptide
ELPTQGTFSNVSTNVSPAKPTTTA

SEQ ID NO: 545 - protein, 12 aa, Artificial Sequence
  Description of Artificial Sequence: Synthetic peptide
GQNDTSQTSSPS

SEQ ID NO: 546 - protein, 16 aa, Homo sapiens
GLAVSTISSFFPPGYQ

SEQ ID NO: 547 - protein, 45 aa, Homo sapiens
TTTPAPRPPTPAPTIASQPLSLRPEACRPAAGGAVHTRGLDFACD

SEQ ID NO: 548 - protein, 231 aa, Homo sapiens
EPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 549 - protein, 21 aa, Homo sapiens
IYIWAPLAGTCGVLLLSLVIT

SEQ ID NO: 550 - protein, 27 aa, Homo sapiens
FWVLVVVGGVLACYSLLVTVAFIIFWV

SEQ ID NO: 551 - protein, 41 aa, Homo sapiens
RSKRSRLLHSDYMNMTPRRPGPTRKHYQPYAPPRDFAAYRS

SEQ ID NO: 552 - protein, 136 aa, Artificial Sequence
  Description of Artificial Sequence: Synthetic polypeptide
CPYSNPSLCSGGGGSELPTQGTFSNVSTNVSPAKPTTTACPYSNPSLCSGGGGSPAPRPPTPAPTIASQPLSLRPEACRPAAGGAVHTRGLDFACDIYIWAPLAGTCGVLLLSLVITLYCNHRNRRRVCKCPRPVV

SEQ ID NO: 553 - protein, 21 aa, Artificial Sequence
  Description of Artificial Sequence: Synthetic peptide
MGTSLLCWMALCLLGADHADA

SEQ ID NO: 554 - protein, 157 aa, Artificial Sequence
  Description of Artificial Sequence: Synthetic polypeptide
MGTSLLCWMALCLLGADHADACPYSNPSLCSGGGGSELPTQGTFSNVSTNVSPAKPTTTACPYSNPSLCSGGGGSPAPRPPTPAPTIASQPLSLRPEACRPAAGGAVHTRGLDFACDIYIWAPLAGTCGVLLLSLVITLYCNHRNRRRVCKCPRPVV

SEQ ID NO: 555 - DNA, 63 bp, Homo sapiens
atggcactccccgtaactgctctgctgctgccgttggcattgctcctgcacgccgcacgcccg

SEQ ID NO: 556 - protein, 624 aa, Homo sapiens
METDTLLLWVLLLWVPGSTGYPYDVPDYAGMLAGVFELQIHSFGPGPGPGAPRSPCSARLPCRLFFRVCLKPGLSEEAAESPCALGAALSARGPVYTEQPGAPAPDLPLPDGLLQVPFRDAWPGTFSFIIETWREELGDQIGGPAWSLLARVAGRRRLAAGGPWARDIQRAGAWELRFSYRARCEPPAVGTACTRLCRPRSAPSRCGPGLRPCAPLEDECEAPLVCRAGCSPEHGFCEQPGECRCLEGWTGPLCTVPVSTSSCLSPRGPSSATTGCLVPGPGPCDGNPCANGGSCSETPRSFECTCPRGFYGLRCEVSGVTCADGPCFNGGLCVGGADPDSAYICHCPPGFQGSNCEKRVDRCSLQPCRNGGLCLDLGHALRCRCRAGFAGPRCEHDLDDCAGRACANGGTCVEGGGAHRCSCALGFGGRDCRERADPCAARPCAHGGRCYAHFSGLVCACAPGYMGARCEFPVHPDGASALPAAPPGLRPGDPQRYLLPPALGLLVAAGVAGAALLLVHVRRRGHSQDAGSRLLAGTPEPSVHALPDALNNLRTQEGSGDGPSSSVDWNRPEDVDPQGIYVISAPSIYAREVATPLFPPLHTGRAGQRQHLLFPYPSSILSVK

SEQ ID NO: 557 - protein, 477 aa, Artificial Sequence
  Description of Artificial Sequence: Synthetic polypeptide
METDTLLLWVLLLWVPGSTGYPYDVPDYAGMLGSARCEPPAVGTACTRLCRPRSAPSRCGPGLRPCAPLEDECEAPLVCRAGCSPEHGFCEQPGECRCLEGWTGPLCTVPVSTSSCLSPRGPSSATTGCLVPGPGPCDGNPCANGGSCSETPRSFECTCPRGFYGLRCEVSGVTCADGPCFNGGLCVGGADPDSAYICHCPPGFQGSNCEKRVDRCSLQPCRNGGLCLDLGHALRCRCRAGFAGPRCEHDLDDCAGRACANGGTCVEGGGAHRCSCALGFGGRDCRERADPCAARPCAHGGRCYAHFSGLVCACAPGYMGARCEFPVHPDGASALPAAPPGLRPGDPQRYLLPPALGLLVAAGVAGAALLLVHVRRRGHSQDAGSRLLAGTPEPSVHALPDALNNLRTQEGSGDGPSSSVDWNRPEDVDPQGIYVISAPSIYAREVATPLFPPLHTGRAGQRQHLLFPYPSSILSVK

SEQ ID NO: 558 - protein, 437 aa, Artificial Sequence
  Description of Artificial Sequence: Synthetic polypeptide
METDTLLLWVLLLWVPGSTGYPYDVPDYAGMLGSAPLVCRAGCSPEHGFCEQPGECRCLEGWTGPLCTVPVSTSSCLSPRGPSSATTGCLVPGPGPCDGNPCANGGSCSETPRSFECTCPRGFYGLRCEVSGVTCADGPCFNGGLCVGGADPDSAYICHCPPGFQGSNCEKRVDRCSLQPCRNGGLCLDLGHALRCRCRAGFAGPRCEHDLDDCAGRACANGGTCVEGGGAHRCSCALGFGGRDCRERADPCAARPCAHGGRCYAHFSGLVCACAPGYMGARCEFPVHPDGASALPAAPPGLRPGDPQRYLLPPALGLLVAAGVAGAALLLVHVRRRGHSQDAGSRLLAGTPEPSVHALPDALNNLRTQEGSGDGPSSSVDWNRPEDVDPQGIYVISAPSIYAREVATPLFPPLHTGRAGQRQHLLFPYPSSILSVK

SEQ ID NO: 559 - protein, 379 aa, Artificial Sequence
  Description of Artificial Sequence: Synthetic polypeptide
METDTLLLWVLLLWVPGSTGYPYDVPDYAGMLGSGPGPCDGNPCANGGSCSETPRSFECTCPRGFYGLRCEVSGVTCADGPCFNGGLCVGGADPDSAYICHCPPGFQGSNCEKRVDRCSLQPCRNGGLCLDLGHALRCRCRAGFAGPRCEHDLDDCAGRACANGGTCVEGGGAHRCSCALGFGGRDCRERADPCAARPCAHGGRCYAHFSGLVCACAPGYMGARCEFPVHPDGASALPAAPPGLRPGDPQRYLLPPALGLLVAAGVAGAALLLVHVRRRGHSQDAGSRLLAGTPEPSVHALPDALNNLRTQEGSGDGPSSSVDWNRPEDVDPQGIYVISAPSIYAREVATPLFPPLHTGRAGQRQHLLFPYPSSILSVK

SEQ ID NO: 560 - protein, 341 aa, Artificial Sequence
  Description of Artificial Sequence: Synthetic polypeptide
METDTLLLWVLLLWVPGSTGYPYDVPDYAGMLGSSGVTCADGPCFNGGLCVGGADPDSAYICHCPPGFQGSNCEKRVDRCSLQPCRNGGLCLDLGHALRCRCRAGFAGPRCEHDLDDCAGRACANGGTCVEGGGAHRCSCALGFGGRDCRERADPCAARPCAHGGRCYAHFSGLVCACAPGYMGARCEFPVHPDGASALPAAPPGLRPGDPQRYLLPPALGLLVAAGVAGAALLLVHVRRRGHSQDAGSRLLAGTPEPSVHALPDALNNLRTQEGSGDGPSSSVDWNRPEDVDPQGIYVISAPSIYAREVATPLFPPLHTGRAGQRQHLLFPYPSSILSVK

SEQ ID NO: 561 - protein, 300 aa, Artificial Sequence
  Description of Artificial Sequence: Synthetic polypeptide
METDTLLLWVLLLWVPGSTGYPYDVPDYAGMLGSRVDRCSLQPCRNGGLCLDLGHALRCRCRAGFAGPRCEHDLDDCAGRACANGGTCVEGGGAHRCSCALGFGGRDCRERADPCAARPCAHGGRCYAHFSGLVCACAPGYMGARCEFPVHPDGASALPAAPPGLRPGDPQRYLLPPALGLLVAAGVAGAALLLVHVRRRGHSQDAGSRLLAGTPEPSVHALPDALNNLRTQEGSGDGPSSSVDWNRPEDVDPQGIYVISAPSIYAREVATPLFPPLHTGRAGQRQHLLFPYPSSILSVK

SEQ ID NO: 562 - protein, 262 aa, Artificial Sequence
  Description of Artificial Sequence: Synthetic polypeptide
METDTLLLWVLLLWVPGSTGYPYDVPDYAGMLGSDLDDCAGRACANGGTCVEGGGAHRCSCALGFGGRDCRERADPCAARPCAHGGRCYAHFSGLVCACAPGYMGARCEFPVHPDGASALPAAPPGLRPGDPQRYLLPPALGLLVAAGVAGAALLLVHVRRRGHSQDAGSRLLAGTPEPSVHALPDALNNLRTQEGSGDGPSSSVDWNRPEDVDPQGIYVISAPSIYAREVATPLFPPLHTGRAGQRQHLLFPYPSSILSVK

SEQ ID NO: 563 - protein, 224 aa, Artificial Sequence
  Description of Artificial Sequence: Synthetic polypeptide
METDTLLLWVLLLWVPGSTGYPYDVPDYAGMLGSRADPCAARPCAHGGRCYAHFSGLVCACAPGYMGARCEFPVHPDGASALPAAPPGLRPGDPQRYLLPPALGLLVAAGVAGAALLLVHVRRRGHSQDAGSRLLAGTPEPSVHALPDALNNLRTQEGSGDGPSSSVDWNRPEDVDPQGIYVISAPSIYAREVATPLFPPLHTGRAGQRQHLLFPYPSSILSVK

SEQ ID NO: 564 - DNA, 45 bp, Artificial Sequence
  Description of Artificial Sequence: Synthetic oligonucleotide
ggcggtggaggctccggaggggggggctctggcggagggggctcc

SEQ ID NO: 565 - protein, 524 aa, Artificial Sequence
  Description of Artificial Sequence: Synthetic polypeptide
MALPVTALLLPLALLLHAARPGGGGSCPYSNPSLCGGGGSCPYSNPSLCGGGGSEVQLLESGGGLVQPGGSLRLSCAASGFTFSSYAMNWVRQAPGKGLEWVSTISGSGGSTYYADSVKGRFTISRDNSKNTLYLQMNSLRAEDTAVFYCAIDPEYYDILTGGDYWGQGTLVTVSSGGGGSGGGGSGGGGGSGGGGSDIQMTQSPSAMSASVGDRVTITCRASQGISNYLAWFQQKPGKVPKRLIYAASSLQSGVPSRFSGSGSGTEFTLTISSLQPEDFATYFCLQHDSFPLTFGGGTKVEIKTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 566 - DNA, 54 bp, Artificial Sequence
  Description of Artificial Sequence: Synthetic oligonucleotide
gggtctacatccggctccgggaagcccggaagtggcgaaggtagtacaaagggg

SEQ ID NO: 567 - DNA, 123 bp, Homo sapiens
agatccaaaagaagccgcctgctccatagcgattacatgaatatgactccacgccgccctggccccacaaggaaacactaccagccttacgcaccacctagagatttcgctgcctatcggagc

SEQ ID NO: 568 - DNA, 126 bp, Homo sapiens
aagcgcggcaggaagaagctcctctacatttttaagcagccttttatgaggcccgtacagacaacacaggaggaagatggctgtagctgcagatttcccgaggaggaggaaggtgggtgcgagctg

SEQ ID NO: 569 - DNA, 336 bp, Homo sapiens
agggtgaagttttccagatctgcagatgcaccagcgtatcagcagggccagaaccaactgtataacgagctcaacctgggacgcagggaagagtatgacgttttggacaagcgcagaggacgggaccctgagatgggtggcaaaccaagacgaaaaaacccccaggagggtctctataatgagctgcagaaggataagatggctgaagcctattctgaaataggcatgaaaggagagcggagaaggggaaaagggcacgacggtttgtaccagggactcagcactgctacgaaggatacttatgacgctctccacatgcaagccctgccacctagg

SEQ ID NO: 570 - DNA, 1458 bp, Artificial Sequence
  Description of Artificial Sequence: Synthetic polynucleotide
atggctctgcccgtcaccgctctgctgctgcctctggctctgctgctgcacgccgcacgaccacaggtccaggtgcagctgcaggagagcggcccaggcctggtgaagccatctgagacactgagcctgacctgcacagtgagcgataactccatctctaattactattggtcctggatcaggcagccccctggcaagggcctggagtggatcgcctacatctactattctggcaccacaaactataatcccagcctgaagtccagagtgaccatctccctggacacatctaagaaccagttctccctgaagctgagctccgtgaccgcagcagatacagccgtgtactattgtgcccggctgtttaattggggcttcgcctttgacatctggggccagggcaccatggtgacagtgtctagcggaggaggaggaagcggaggaggagggtccggaggcgggggatctgagatcgtgatgacccagtctccagccacactgtccgtgtctcccggcgagagggccaccctgagctgcagagccagccagtccgtgagctccaacctggcctggtaccagcagaagcctggccaggcacctcggctgctgatctatggagcatccaccagggccacaggaatccctgcacgcttctctggaagcggatccggcacagagtttaccctgacaatctctagcctgcagtctgaggacttcgccgtgtactattgtcagcagtacaacaattggcccctgacctttggcggcggcacaaaggtggagatcaagaccacaactcctgcacctaggccacctaccccagcacctacaattgctagtcagccactgtcactgcgaccagaggcatgtcgacctgcagctggaggagcagtgcatacaaggggactggactttgcctgcgatatctacatttgggctcctctggcaggaacatgtggcgtgctgctgctgagcctggtcatcactctgtactgcaagcgaggccggaagaaactgctgtatattttcaaacagccctttatgcgacctgtgcagaccacacaggaggaagatgggtgctcctgtcggttccccgaggaagaggaaggaggctgtgagctgcgggtcaagttttccagatctgcagacgcccctgcttaccagcagggccagaaccagctgtataacgagctgaatctggggcggagagaggaatacgacgtgctggataaaaggcgcgggagagacccagaaatggggggaaagccacgacggaaaaacccccaggagggactgtacaatgaactgcagaaggataaaatggcagaggcctattccgaaatcgggatgaagggagaaagaaggcgaggcaaaggacacgacggactgtaccaggggctgtctaccgccacaaaggacacctatgatgctctgcatatgcaggcactgccacccagg

SEQ ID NO: 571 - DNA, 1455 bp, Artificial Sequence
  Description of Artificial Sequence: Synthetic polynucleotide
atggctctgcccgtcaccgctctgctgctgcctctggctctgctgctgcacgccgcacgaccacaggtgcagctgcaggagtctggcccaggcctgatgaagcccagcgagacactgtccctgacctgcacagtgtctggcggcagcatcagctcctcttactggagctgtatcaggcagccccctggcaagggcctggagtggatcggctacatctactattccggcaccacaaactataatccttccctgaagtctcgggtgaccctgtctctggacacaagcaagaaccagttctccctgagactgacctctgtgacagccgccgataccgccgtgtactattgcgccagagtggcccccacaggcttctggtttgactattggggccagggcaccctggtgacagtgagctccggaggaggaggaagcggaggaggagggtccggaggcgggggatctgagatcgtgctgacccagtccccaggcacactgtccctgtctcccggcgagagagccaccctgagctgcagggcctcccagagagtgagctccaggtacctggcctggtatcagcagaagcctggccaggcccccagactgctgatctacggagcatctagccgcgccaccggaatcccagaccggttcagcggatccggatctggcacagacttcaccctgacaatctctagactggagcctgaggagttcgccgtgtactattgtcagcagtatggcaccagcccactgacatttggcggcggcacaaaggtggagatcaagaccacaactcctgcacctaggccacctaccccagcacctacaattgctagtcagccactgtcactgcgaccagaggcatgtcgacctgcagctggaggagcagtgcatacaaggggactggactttgcctgcgatatctacatttgggctcctctggcaggaacatgtggcgtgctgctgctgagcctggtcatcactctgtactgcaagcgaggccggaagaaactgctgtatattttcaaacagccctttatgcgacctgtgcagaccacacaggaggaagatgggtgctcctgtcggttccccgaggaagaggaaggaggctgtgagctgcgggtcaagttttccagatctgcagacgcccctgcttaccagcagggccagaaccagctgtataacgagctgaatctggggcggagagaggaatacgacgtgctggataaaaggcgcgggagagacccagaaatggggggaaagccacgacggaaaaacccccaggagggactgtacaatgaactgcagaaggataaaatggcagaggcctattccgaaatcgggatgaagggagaaagaaggcgaggcaaaggacacgacggactgtaccaggggctgtctaccgccacaaaggacacctatgatgctctgcatatgcaggcactgccacccagg

SEQ ID NO: 572 - DNA, 1470 bp, Artificial Sequence
  Description of Artificial Sequence: Synthetic polynucleotide
atggctctgcccgtcaccgctctgctgctgcctctggctctgctgctgcacgccgcacgaccacaggtccagctggtccagtcaggggccgaggtgaagaaacctggggcttctgtgaaggtcagttgcaaagctagtggatactcattccctgattactatatcaactgggtgcgccaggcaccaggacagggactggagtggatgggatggatctacttcgctagcggcaactccgaatataatcagaagtttacaggcagagtgactatgaccagggacacaagctcctctactgcctatatggagctgagttcactgcggagtgaagataccgcagtgtacttctgcgcctctctgtacgactatgattggtattttgacgtctggggacagggcactatggtgaccgtcagctccggaggaggaggaagcggaggaggagggtccggaggcgggggatctgatatcgtgatgacacagactcccctgtcactgagcgtcactccaggagagccagcatccatttcttgtaagtctagtcagtcactggtgcacagcaacggaaatacctacctgcattggtatctgcagaagcctggccagagcccacagctgctgatctacaaagtgtccaataggttctctggcgtcccagaccgctttagtgggtcaggaagcggcgccgatttcaccctgaaaattagccgcgtggaggctgaagacgtgggcgtctactattgcgcagagacaagccacgtcccctggacttttgggcagggaaccaagctggaaatcaaaaccacaactcctgcacctaggccacctaccccagcacctacaattgctagtcagccactgtcactgcgaccagaggcatgtcgacctgcagctggaggagcagtgcatacaaggggactggactttgcctgcgatatctacatttgggctcctctggcaggaacatgtggcgtgctgctgctgagcctggtcatcactctgtactgcaagcgaggccggaagaaactgctgtatattttcaaacagccctttatgcgacctgtgcagaccacacaggaggaagatgggtgctcctgtcggttccccgaggaagaggaaggaggctgtgagctgcgggtcaagttttccagatctgcagacgcccctgcttaccagcagggccagaaccagctgtataacgagctgaatctggggcggagagaggaatacgacgtgctggataaaaggcgcgggagagacccagaaatggggggaaagccacgacggaaaaacccccaggagggactgtacaatgaactgcagaaggataaaatggcagaggcctattccgaaatcgggatgaagggagaaagaaggcgaggcaaaggacacgacggactgtaccaggggctgtctaccgccacaaaggacacctatgatgctctgcatatgcaggcactgccacccagg

SEQ ID NO: 573 - DNA, 1470 bp, Artificial Sequence
  Description of Artificial Sequence: Synthetic polynucleotide
atggctctgcctgtcaccgctctgctgctgcctctggctctgctgctgcacgcggcgcgcccgcaggtgcagctgcaggagtctggcccaggcctggtgaagccctctgagacactgagcctgacctgcacagtgagcgacgattccatctctaactactattggtcctggatcaggcagccccctggcaagggcctggagtggatcggctacatcttctattccggcaccacaaaccacaatcccagcctgaagtcccggctgacaatctccctggacaaggccaagaaccagttctctctgagactgagctccgtgaccgccgccgatacagccgtgtactattgtgccagagtgttcaactggggcttcgcctttgacatctggggccagggcaccatggtgacagtgtctagcggcggcggcggctctggaggaggaggcagcggcggaggaggctccggaggcggcggctctgagatcgtgctgacccagtctccaggcacactgtctctgagccccggcgagagggccaccctgagctgccgcgcctcccagcggatctctagaacatacctggcctggtatcagcagaagcctggccaggcccccagactgctgatctacggagcaagcagccgggccaccggaatccccgacagattcaccggctccggctctggcacagacttcaccctgacaatcagcagactggagcctgaggacttcgccgtgtactattgtcagcagtatggcacctccccactgacatttggcggcggcacaaaggtggagatcaacaccacaaccccagcacctaggccacctacacctgcaccaaccatcgccagccagcctctgtccctgagaccagaggcctgtaggccagcagcaggaggagcagtgcacacccggggcctggacttcgcctgcgatatctacatctgggcaccactggcaggaacatgtggcgtgctgctgctgtccctggtcatcaccctgtactgcaagagaggcaggaagaagctgctgtatatcttcaagcagcccttcatgagacccgtgcagacaacccaggaggaggacggctgcagctgtaggttcccagaggaggaggagggaggatgtgagctgcgcgtgaagttttcccggtctgccgatgcacctgcataccagcagggacagaaccagctgtataacgagctgaatctgggccggagagaggagtacgacgtgctggataagaggaggggaagggaccctgagatgggaggcaagcctcggagaaagaacccacaggagggcctgtacaatgagctgcagaaggacaagatggccgaggcctatagcgagatcggcatgaagggagagaggcgccggggcaagggacacgatggcctgtatcagggcctgtcaaccgctacaaaagatacctacgatgctctgcacatgcaggctctgccaccaaga

SEQ ID NO: 574 - DNA, 1470 bp, Artificial Sequence
  Description of Artificial Sequence: Synthetic polynucleotide
atggctctgcctgtcaccgctctgctgctgcctctggctctgctgctgcacgcggcgcgcccgcaggtgcagctgcaggagagcggcccaggcctggtgaagccatctgagacactgagcctgacctgcacagtgagcgataactccatctctaattactattggtcctggatcaggcagccccctggcaagggcctggagtggatcgcctacatctactattctggcaccacaaactataatcccagcctgaagtccagagtgaccatctccctggacacatctaagaaccagttctccctgcagctgagctccgtgacagcagcagatgcagccgtgtactattgtgccagagtgttccactggggcttcgcctttgacatctggggccagggcaccatggtgacagtgtctagcggcggcggcggctctggaggaggaggcagcggcggaggaggctccggaggcggcggctctgagatcgtgctgacccagagcccaggcacactgtctctgagccccggcgagagggccaccctgtcctgccgggcctctcagagagtgagcaacacatacctggcctggtatcagcagaatcccggccaggcccccagactgctgatctacggagcaagctccagggccaccggaatcccagaccgcttctccggatctggaagcggcacagacttcaccctgacaatctcccggctggagcctgaggacttcgccgtgtactattgtcagcagtatggcacctctccactgacatttggcggcggcaccaaggtggagatcaagaccacaaccccagcacctaggccacctacacctgcaccaaccatcgccagccagcctctgtccctgagaccagaggcctgtaggccagcagcaggaggagcagtgcacacccggggcctggacttcgcctgcgatatctacatctgggcaccactggcaggaacatgtggcgtgctgctgctgtccctggtcatcaccctgtactgcaagagaggcaggaagaagctgctgtatatcttcaagcagcccttcatgagacccgtgcagacaacccaggaggaggacggctgcagctgtaggttcccagaggaggaggagggaggatgtgagctgcgcgtgaagttttcccggtctgccgatgcacctgcataccagcagggacagaaccagctgtataacgagctgaatctgggccggagagaggagtacgacgtgctggataagaggaggggaagggaccctgagatgggaggcaagcctcggagaaagaacccacaggagggcctgtacaatgagctgcagaaggacaagatggccgaggcctatagcgagatcggcatgaagggagagaggcgccggggcaagggacacgatggcctgtatcagggcctgtcaaccgctacaaaagatacctacgatgctctgcacatgcaggctctgccaccaaga

SEQ ID NO: 575 - DNA, 1455 bp, Artificial Sequence
  Description of Artificial Sequence: Synthetic polynucleotide
atggctctgcccgtcaccgctctgctgctgcctctggctctgctgctgcacgccgcacgaccacaggtgcagctgcaggagagcggcccaggcctggtgaagccatccgagaccctgtctctgacctgcacagtgagcaacgtgtccatcagctcctactattggtcttggatcaggcagccccctggcaagggactggagtggatcggctacatctactatagcggcaccacaaactataatccctctctgaagagcagagtgaccatgagcgtggacacatccaagaaccagttctccctgaagctgtctagcgtgaccgccgccgatacagccgtgtacttttgtgcccggctgtctaattggggcttcgcctttgacatctggggccagggcaccatggtgacattctcctctggaggaggaggaagcggaggaggagggtccggaggcgggggatctgagatcgtgctgacccagtctccaggcacactgtctctgagccccggcgagagggccaccctgtcctgcagagcctctcagacaatcagctcctcttacctggcctggtatcagcagaagcctggccaggcacctcggctgctgatctacggagcaagctccagggccaccggaatcccagaccgcttctccggatctggaagcggcacagagtttaccctgacaatcagccggctggagcctgaggatttcgccgtgtactattgtcagcagtatggctggtccccaatcacctttggccagggcacaaggctggagatcaagaccacaactcctgcacctaggccacctaccccagcacctacaattgctagtcagccactgtcactgcgaccagaggcatgtcgacctgcagctggaggagcagtgcatacaaggggactggactttgcctgcgatatctacatttgggctcctctggcaggaacatgtggcgtgctgctgctgagcctggtcatcactctgtactgcaagcgaggccggaagaaactgctgtatattttcaaacagccctttatgcgacctgtgcagaccacacaggaggaagatgggtgctcctgtcggttccccgaggaagaggaaggaggctgtgagctgcgggtcaagttttccagatctgcagacgcccctgcttaccagcagggccagaaccagctgtataacgagctgaatctggggcggagagaggaatacgacgtgctggataaaaggcgcgggagagacccagaaatggggggaaagccacgacggaaaaacccccaggagggactgtacaatgaactgcagaaggataaaatggcagaggcctattccgaaatcgggatgaagggagaaagaaggcgaggcaaaggacacgacggactgtaccaggggctgtctaccgccacaaaggacacctatgatgctctgcatatgcaggcactgccacccagg

SEQ ID NO: 576 - DNA, 1473 bp, Artificial Sequence
  Description of Artificial Sequence: Synthetic polynucleotide
atggctctgcccgtcaccgctctgctgctgcctctggctctgctgctgcacgccgcacgaccagaggtgcagctggtggagagcggaggaggactggtgcagcctggcggatccctgaggctgtcttgcgcagcaagcggcttcacctttagctcctacgacatgcactgggtgaggcaggcaacaggcaagggactggagtgggtgtccgccatcggaccagccggcgatacctactatcccggctctgtgaagggccggttcacaatctccagagagaacgccaagaattctctgtatctgcagatgaacagcctgagggcaggcgacaccgccgtgtactattgtgccagagccgaccccccttactattactatggcatggacgtgtggggccagggcaccacagtgacagtgtctagcggaggaggaggaagcggaggaggagggtccggaggcgggggatctgacatcgtgatgacccagtcccctctgtctctgcccgtgacacctggcgagccagcctctatcagctgcaggagctcccagagcctgctgcactccaacgagtacaattatctggattggtacctgcagaagcctggccagtcccctcagctgctgatctatctgggctctaacagggcaagcggagtgccagacagattctccggctctggcagcggcaccgacttcatcctgaagatctctcgggtggaggcagaggacgtgggcgtgtactattgtatgcaggccctggagatcccactgaccttcggcggaggaacaaaggtggagatcaagaccacaactcctgcacctaggccacctaccccagcacctacaattgctagtcagccactgtcactgcgaccagaggcatgtcgacctgcagctggaggagcagtgcatacaaggggactggactttgcctgcgatatctacatttgggctcctctggcaggaacatgtggcgtgctgctgctgagcctggtcatcactctgtactgcaagcgaggccggaagaaactgctgtatattttcaaacagccctttatgcgacctgtgcagaccacacaggaggaagatgggtgctcctgtcggttccccgaggaagaggaaggaggctgtgagctgcgggtcaagttttccagatctgcagacgcccctgcttaccagcagggccagaaccagctgtataacgagctgaatctggggcggagagaggaatacgacgtgctggataaaaggcgcgggagagacccagaaatggggggaaagccacgacggaaaaacccccaggagggactgtacaatgaactgcagaaggataaaatggcagaggcctattccgaaatcgggatgaagggagaaagaaggcgaggcaaaggacacgacggactgtaccaggggctgtctaccgccacaaaggacacctatgatgctctgcatatgcaggcactgccacccagg

SEQ ID NO: 577 - DNA, 1458 bp, Artificial Sequence
  Description of Artificial Sequence: Synthetic polynucleotide
atggctctgcccgtcaccgctctgctgctgcctctggctctgctgctgcacgccgcacgaccacagatcacactgaaggagagcggcccaaccctggtgaagcccacccagacactgaccctgacatgcaccttctccggcttttctctgagcaccagaggcgtgggagtgggatggatcagacagccccctggcaaggccctggagtggctggccctgatctactggaacgacgataagaggtattccccttctctgcagacacgcctgacaatcaccaaggacaccccaaagaaccaggtggtgctgacaatgaccaatatggaccccgtggatacagccacctactattgtgcccggtctaactggggcaattggtacttcgcactgtggggaaggggcacactggtgaccgtgagctccggaggaggaggaagcggaggaggagggtccggaggcgggggatctgagatcgtgctgacccagtctccagccacactgtccctgtctcccggcgagagggccaccctgagctgcagagccagccagtccgtgagctcctacctggcctggtatcagcagaagcctggccaggcacctcggctgctgatctacgacgccttctatagggccaccggcatcccagcacgcttctctggaagcggatccggcacagactttaccctgacaatctctagcctggagcctgaggatttcgccgtgtactattgtcagcaccggtccaactggccaatcacctttggccagggcacaaggctggagatcaagaccacaactcctgcacctaggccacctaccccagcacctacaattgctagtcagccactgtcactgcgaccagaggcatgtcgacctgcagctggaggagcagtgcatacaaggggactggactttgcctgcgatatctacatttgggctcctctggcaggaacatgtggcgtgctgctgctgagcctggtcatcactctgtactgcaagcgaggccggaagaaactgctgtatattttcaaacagccctttatgcgacctgtgcagaccacacaggaggaagatgggtgctcctgtcggttccccgaggaagaggaaggaggctgtgagctgcgggtcaagttttccagatctgcagacgcccctgcttaccagcagggccagaaccagctgtataacgagctgaatctggggcggagagaggaatacgacgtgctggataaaaggcgcgggagagacccagaaatggggggaaagccacgacggaaaaacccccaggagggactgtacaatgaactgcagaaggataaaatggcagaggcctattccgaaatcgggatgaagggagaaagaaggcgaggcaaaggacacgacggactgtaccaggggctgtctaccgccacaaaggacacctatgatgctctgcatatgcaggcactgccacccagg

SEQ ID NO: 578 - DNA, 1470 bp, Artificial Sequence
  Description of Artificial Sequence: Synthetic polynucleotide
atggctctgcctgtcaccgctctgctgctgcctctggctctgctgctgcacgcggcgcgcccgcaggtgcagctgcaggagagcggcccaggcctggtgaagccatctgagaccctgagcctgacctgcacagtgtccggcgattccatctctaactactattggacatggatcaggcagccccctggcaagggactggagtggatcggctacatctactattctggcaccacaaactctaatcccagcctgaagagccgggtgaccgtgtccctggacacaagcaagtcccagttctctctgaacctgagctccgtgaccgccgccgatacagccgtgtactattgtgccagagtgttcaacagaggcttcgcctttgacatctggggccagggcaccatggtgacagtgtctagcggcggcggcggctctggaggaggaggcagcggcggaggaggctccggaggcggcggctctgagatcgtgctgacccagagcccaggcacactgtctctgagccccggcgagagggccaccctgtcctgccgggcctctcagagaatcagcaacacatacctggcctggtatcagcagaagcctggccaggcccccagactgctgatctacggagcaagctccagggccaccggaatcccagaccgcttctccggatctggaagcggcacagacttcaccctgacaatctccaggctggagcctgaggacttcgcagcctactattgtcagcagtatgatacctctccactgacatttggcggcggcaccaaggtggagatcaagaccacaaccccagcacctaggccacctacacctgcaccaaccatcgccagccagcctctgtccctgagaccagaggcctgtaggccagcagcaggaggagcagtgcacacccggggcctggacttcgcctgcgatatctacatctgggcaccactggcaggaacatgtggcgtgctgctgctgtccctggtcatcaccctgtactgcaagagaggcaggaagaagctgctgtatatcttcaagcagcccttcatgagacccgtgcagacaacccaggaggaggacggctgcagctgtaggttcccagaggaggaggagggaggatgtgagctgcgcgtgaagttttcccggtctgccgatgcacctgcataccagcagggacagaaccagctgtataacgagctgaatctgggccggagagaggagtacgacgtgctggataagaggaggggaagggaccctgagatgggaggcaagcctcggagaaagaacccacaggagggcctgtacaatgagctgcagaaggacaagatggccgaggcctatagcgagatcggcatgaagggagagaggcgccggggcaagggacacgatggcctgtatcagggcctgtcaaccgctacaaaagatacctacgatgctctgcacatgcaggctctgccaccaaga

SEQ ID NO: 579 - DNA, 1482 bp, Artificial Sequence
  Description of Artificial Sequence: Synthetic polynucleotide
atggctctgcccgtcaccgctctgctgctgcctctggctctgctgctgcacgccgcacgaccacaggtgacactgagggagtctggacccgccctggtgaagcctacccagacactgaccctgacatgcaccgtgagcggcgtgtctctgagcacctccggcatgtgcgtgagctggatcaggcagccactgggcaaggccctggagtggctgggcttcatcgattgggacgatgacaagtactataacacaagcctgaagacacgcctgaccatctccaaggacacctctaagaaccaggtggtgctgacaatgaccaatatggatcccgtggacacagccacctactattgcgcccggatcagaggctactctggcagctatgatgcctttgacatctggggccagggcaccgtggtcatcgtgagctccggaggaggaggaagcggaggaggagggtccggaggcgggggatctgacatcgtgatgacccagtcccctctgtctctgcccgtgacacctggcgagccagcctctatcagctgcaggagctcccagagcctgctgcactccaacggctacaatcacctggattggtatctgcagaagcctggccagtcccctcaggtgctgatctacctgggctctaacagggcaagcggagtgccagacagattctccggatctggaagcggaaccgacttcaccctgaagatctctcgggtggaggcagaggacgtgggcgtgtatttctgtatgcaggccctgcagacccccctgacatttggcggcggcaccaaggtggagatcaagaccacaactcctgcacctaggccacctaccccagcacctacaattgctagtcagccactgtcactgcgaccagaggcatgtcgacctgcagctggaggagcagtgcatacaaggggactggactttgcctgcgatatctacatttgggctcctctggcaggaacatgtggcgtgctgctgctgagcctggtcatcactctgtactgcaagcgaggccggaagaaactgctgtatattttcaaacagccctttatgcgacctgtgcagaccacacaggaggaagatgggtgctcctgtcggttccccgaggaagaggaaggaggctgtgagctgcgggtcaagttttccagatctgcagacgcccctgcttaccagcagggccagaaccagctgtataacgagctgaatctggggcggagagaggaatacgacgtgctggataaaaggcgcgggagagacccagaaatggggggaaagccacgacggaaaaacccccaggagggactgtacaatgaactgcagaaggataaaatggcagaggcctattccgaaatcgggatgaagggagaaagaaggcgaggcaaaggacacgacggactgtaccaggggctgtctaccgccacaaaggacacctatgatgctctgcatatgcaggcactgccacccagg

SEQ ID NO: 580 - DNA, 1452 bp, Artificial Sequence
  Description of Artificial Sequence: Synthetic polynucleotide
atggctctgcccgtcaccgctctgctgctgcctctggctctgctgctgcacgccgcacgaccacaggtgcagctgcaggtgtccggccctggcctggtgaagccttccgagacactgtctctgacctgcagcgtgtccggcggctctatcagctcctactattggtcttggatcaggcagagcccaggcaagggactggattggatcggctacatgtactatagcggcaccacaaactataatccctctctgaagagcagagtgacaatcagcgtggacacctccaagaaccagttttccctgaagctgtctagcgtgaccgccacagataccgccgtgtactattgtgccagagtgggcctgacaggcttctttttcgactactggggccagggcacactggtgaccgtgtcctctggaggaggaggaagcggaggaggagggtccggaggcgggggatctgccatccagatgacccagtcccctagctccctgagcgcctccgtgggcgacagggtgaccatcacatgcagagcctctcagggcatcaggaacgatctgggctggtatcagcagaagcccggcaaggcccctaagctgctgatctacgcagcatctagcctgcagtctggagtgccaagccggttctctggaagcggatccggcaccgactttaccctgacagtgtcctctctgcagccagaggacttcgccacatactattgtctgcaggattacaattatccctacacctttggccagggcacaaagctggagatcaagaccacaactcctgcacctaggccacctaccccagcacctacaattgctagtcagccactgtcactgcgaccagaggcatgtcgacctgcagctggaggagcagtgcatacaaggggactggactttgcctgcgatatctacatttgggctcctctggcaggaacatgtggcgtgctgctgctgagcctggtcatcactctgtactgcaagcgaggccggaagaaactgctgtatattttcaaacagccctttatgcgacctgtgcagaccacacaggaggaagatgggtgctcctgtcggttccccgaggaagaggaaggaggctgtgagctgcgggtcaagttttccagatctgcagacgcccctgcttaccagcagggccagaaccagctgtataacgagctgaatctggggcggagagaggaatacgacgtgctggataaaaggcgcgggagagacccagaaatggggggaaagccacgacggaaaaacccccaggagggactgtacaatgaactgcagaaggataaaatggcagaggcctattccgaaatcgggatgaagggagaaagaaggcgaggcaaaggacacgacggactgtaccaggggctgtctaccgccacaaaggacacctatgatgctctgcatatgcaggcactgccacccagg

SEQ ID NO: 581 - DNA, 1443 bp, Artificial Sequence
  Description of Artificial Sequence: Synthetic polynucleotide
atggctctgcccgtcaccgctctgctgctgcctctggctctgctgctgcacgccgcacgaccacaggtgcagctgcagcagtggggaggaggactgctgaagccctccgagaccctgtctctgacatgcgccgtgtacggaggaagctcctctggaaactattggtcctggatccggcagccccctggcaagagactggagtggatcggcgagatcaaccacagcggcaccacatcctacaatccttctctgaagagcagggtgaccatctctgtggacacaagcaagaatcagttctccctgaagctgagctccgtgaccgcagcagatacagccgtgtactattgcgccagaggcgagctgggaatcgcagacagctggggacagggcaccctggtgacagtgtctagcggaggaggaggaagcggaggaggagggtccggaggcgggggatctgatatccagatgacccagtctcccagcacactgtccgcctctgtgggcgacagggtgaccatcacatgtcgcgccagccagtccatctctcggtggctggcctggtaccagcagaagccaggcaaggcccccaagctgctgatctataaggcctcctctctggagtccggcgtgccttctagattcagcggctccggctctggcaccgagtttaccctgacaatcagctccctgcagccagacgatttcgccacctactattgtcagcagtacaacagctattccacctttggccagggcacaaaggtggagatcaagaccacaactcctgcacctaggccacctaccccagcacctacaattgctagtcagccactgtcactgcgaccagaggcatgtcgacctgcagctggaggagcagtgcatacaaggggactggactttgcctgcgatatctacatttgggctcctctggcaggaacatgtggcgtgctgctgctgagcctggtcatcactctgtactgcaagcgaggccggaagaaactgctgtatattttcaaacagccctttatgcgacctgtgcagaccacacaggaggaagatgggtgctcctgtcggttccccgaggaagaggaaggaggctgtgagctgcgggtcaagttttccagatctgcagacgcccctgcttaccagcagggccagaaccagctgtataacgagctgaatctggggcggagagaggaatacgacgtgctggataaaaggcgcgggagagacccagaaatggggggaaagccacgacggaaaaacccccaggagggactgtacaatgaactgcagaaggataaaatggcagaggcctattccgaaatcgggatgaagggagaaagaaggcgaggcaaaggacacgacggactgtaccaggggctgtctaccgccacaaaggacacctatgatgctctgcatatgcaggcactgccacccagg

SEQ ID NO: 582 - DNA, 1476 bp, Artificial Sequence
  Description of Artificial Sequence: Synthetic polynucleotide
atggctctgcctgtcaccgctctgctgctgcctctggctctgctgctgcacgcggcgcgcccgcagctgcagctgcaggagtccggccctggcctggtgaagccatccgagaccctgtctctgacctgcacagtgagcggcggctccatcagctcctctagctactattggggctggatcagacagccccctggcaagggactggagtggatcggcagcatctactattccggcaacatctaccacaatccttctctgaagagccgcgtgtctatcagcgtggacacctccaagaaccagttctctctgaggctgtcctctgtgaccgcagcagatacagccgtgtactattgcgccagggagatcatcgtgggagcaacccactttgactattggggccagggcaccctggtgacagtgagctccggcggcggcggctctggaggaggaggcagcggcggaggaggctccggaggcggcggctctgccatccagatgacacagtccccatctagcctgtccgcctctgtgggcgacagggtgaccatcacatgtagagccagccagggcatcaggaacgatctgggctggtaccagcagaagccaggcaaggcccccgagctgctgatctatgccgcctcctctctgcagtctggcgtgccaagcagattcagcggctccggctctggcaccgactttaccctgacaatcagctccctgcagcccgaggacttcgccacatactattgtctgcaggattacaattatcccctgacctttggccctggcacaaaggtggatatcaagaccacaaccccagcacctaggccacctacacctgcaccaaccatcgccagccagcctctgtccctgagaccagaggcctgtaggccagcagcaggaggagcagtgcacacccggggcctggacttcgcctgcgatatctacatctgggcaccactggcaggaacatgtggcgtgctgctgctgtccctggtcatcaccctgtactgcaagagaggcaggaagaagctgctgtatatcttcaagcagcccttcatgagacccgtgcagacaacccaggaggaggacggctgcagctgtaggttcccagaggaggaggagggaggatgtgagctgcgcgtgaagttttcccggtctgccgatgcacctgcataccagcagggacagaaccagctgtataacgagctgaatctgggccggagagaggagtacgacgtgctggataagaggaggggaagggaccctgagatgggaggcaagcctcggagaaagaacccacaggagggcctgtacaatgagctgcagaaggacaagatggccgaggcctatagcgagatcggcatgaagggagagaggcgccggggcaagggacacgatggcctgtatcagggcctgtcaaccgctacaaaagatacctacgatgctctgcacatgcaggctctgccaccaaga

SEQ ID NO: 583 - DNA, 1455 bp, Artificial Sequence
  Description of Artificial Sequence: Synthetic polynucleotide
atggctctgcccgtcaccgctctgctgctgcctctggctctgctgctgcacgccgcacgaccacaggtgcagctgcagcagtggggagcaggactgctgaagccctccgagaccctgtctctgacatgcgccgtgtacggaggaagcttctccggatactattggtcctggatcaggcagccccctggcaagggactggagtggatcggcgagatcatccactctggcagctccaactataatccttctctgaagagccgggtgtctatcagcgtggacacctctaagaaccagttcagcctgaagctgtctagcgtgaccgccgccgatacagccgtgtactattgctccagaggcgagtacggctccggctctaggtttgactattggggccagggcaccctggtgacagtgtcctctggaggaggaggaagcggaggaggagggtccggaggcgggggatctgccatccagatgacccagtccccaagctccctgagcgcctccgtgggcgatagggtggccatcacatgtagggcaagccagggaatcagggacgatctgggctggtaccagcagaagccaggcaaggcccccaagctgctgatctatgcagcatctagcctgcagagcggagtgccatcccggttctctggaagcagatccgacaccgacttcaccctgacaatctcctctctgcagcctgaggacttcgccacatactattgtctgcaggactacgattatccactgacctttggcggcggcacaaaggtggagatcaagaccacaactcctgcacctaggccacctaccccagcacctacaattgctagtcagccactgtcactgcgaccagaggcatgtcgacctgcagctggaggagcagtgcatacaaggggactggactttgcctgcgatatctacatttgggctcctctggcaggaacatgtggcgtgctgctgctgagcctggtcatcactctgtactgcaagcgaggccggaagaaactgctgtatattttcaaacagccctttatgcgacctgtgcagaccacacaggaggaagatgggtgctcctgtcggttccccgaggaagaggaaggaggctgtgagctgcgggtcaagttttccagatctgcagacgcccctgcttaccagcagggccagaaccagctgtataacgagctgaatctggggcggagagaggaatacgacgtgctggataaaaggcgcgggagagacccagaaatggggggaaagccacgacggaaaaacccccaggagggactgtacaatgaactgcagaaggataaaatggcagaggcctattccgaaatcgggatgaagggagaaagaaggcgaggcaaaggacacgacggactgtaccaggggctgtctaccgccacaaaggacacctatgatgctctgcatatgcaggcactgccacccagg

SEQ ID NO: 584 - DNA, 1461 bp, Artificial Sequence
  Description of Artificial Sequence: Synthetic polynucleotide
atggctctgcctgtcaccgctctgctgctgcctctggctctgctgctgcacgcggcgcgcccgcaggtgcagctgcaggagtccggccctggcctggtgaagccaagcggcaccctgtccctgacatgcgccgtgtctggcggcagcatcagctccaacaattggtggagctgggtgaggcagccccctggcaagggactggagtggatcggcgacatccaccactccggctctaccaactacaagccatccctgaagtctcgcgtgacaatctctgtggacaagagcaagaaccagttctccctgaatctgatcagcgtgaccgccgccgatacagccgtgtactattgcgccagagaggccggcggctactttgactattggggccagggcatcctggtgaccgtgtctagcggcggcggcggctctggaggaggaggcagcggcggaggaggctccggaggcggcggctctgatatccagatgacccagagcccatccacactgtctgccagcgtgggcgacagggtgaccatcacatgtagagcctcccagtctatctcctcttggctggcctggtatcagcagaagccaggcaaggcccccaagctgctgatcagcaaggcaagctccctggagtccggagtgccatctaggttcagcggatccggctctggccctgagtttaccctgacaatctctagcctgcagcctgccgatttcgccacctactattgtcagcagtacaatagctattccacctttggccagggcacaaagctggagatcaagaccacaaccccagcacctaggccacctacacctgcaccaaccatcgccagccagcctctgtccctgagaccagaggcctgtaggccagcagcaggaggagcagtgcacacccggggcctggacttcgcctgcgatatctacatctgggcaccactggcaggaacatgtggcgtgctgctgctgtccctggtcatcaccctgtactgcaagagaggcaggaagaagctgctgtatatcttcaagcagcccttcatgagacccgtgcagacaacccaggaggaggacggctgcagctgtaggttcccagaggaggaggagggaggatgtgagctgcgcgtgaagttttcccggtctgccgatgcacctgcataccagcagggacagaaccagctgtataacgagctgaatctgggccggagagaggagtacgacgtgctggataagaggaggggaagggaccctgagatgggaggcaagcctcggagaaagaacccacaggagggcctgtacaatgagctgcagaaggacaagatggccgaggcctatagcgagatcggcatgaagggagagaggcgccggggcaagggacacgatggcctgtatcagggcctgtcaaccgctacaaaagatacctacgatgctctgcacatgcaggctctgccaccaaga

SEQ ID NO: 585 - DNA, 1455 bp, Artificial Sequence
  Description of Artificial Sequence: Synthetic polynucleotide
atggctctgcccgtcaccgctctgctgctgcctctggctctgctgctgcacgccgcacgaccacaggtgcagctgcagcagtggggagcaggactgctgaagccctccgagaccctgtctctgacatgcgccgtgtacggcggctccttctctggctactattggacctggatcagacagccccctggcaagggactggagtggatcggcgagatcacccacagcggctccacaaactataatccttctctgaagagcagggtgtctatcagcgtggacacctctaagaaccagttcagcctgaagctgagctccgtgaccgcagcagatacagccgtgtactattgcgccagaggcgagtacggatccggatctcggtttgactattggggccagggcaccctggtgacagtgtctagcggaggaggaggaagcggaggaggagggtccggaggcgggggatctgccatccagatgacccagtccccatcctctctgagcgcctccgtgggcgatagggtggcaatcacatgtagagccagccagggcatcagggacgatctgggctggtaccagcagaagccaggcaaggcccccaagctgctgatctatgcagcaagctccctgcagagcggagtgccatccagattctctggcagcggctccgacaccgacttcaccctgacaatctctagcctgcagcctgaggacttcgccacatactattgtctgcaggactacgattatccactgacctttggcggcggcacaaaggtggagatcaagaccacaactcctgcacctaggccacctaccccagcacctacaattgctagtcagccactgtcactgcgaccagaggcatgtcgacctgcagctggaggagcagtgcatacaaggggactggactttgcctgcgatatctacatttgggctcctctggcaggaacatgtggcgtgctgctgctgagcctggtcatcactctgtactgcaagcgaggccggaagaaactgctgtatattttcaaacagccctttatgcgacctgtgcagaccacacaggaggaagatgggtgctcctgtcggttccccgaggaagaggaaggaggctgtgagctgcgggtcaagttttccagatctgcagacgcccctgcttaccagcagggccagaaccagctgtataacgagctgaatctggggcggagagaggaatacgacgtgctggataaaaggcgcgggagagacccagaaatggggggaaagccacgacggaaaaacccccaggagggactgtacaatgaactgcagaaggataaaatggcagaggcctattccgaaatcgggatgaagggagaaagaaggcgaggcaaaggacacgacggactgtaccaggggctgtctaccgccacaaaggacacctatgatgctctgcatatgcaggcactgccacccagg

SEQ ID NO: 586 - DNA, 1455 bp, Artificial Sequence
  Description of Artificial Sequence: Synthetic polynucleotide
atggctctgcccgtcaccgctctgctgctgcctctggctctgctgctgcacgccgcacgaccacaggtgcagctgcagcagtggggagcaggactgctgaagccctccgagaccctgtctctgacatgcgccgtgtacggcggctccttctctggctactattggtcctggatcagacagccccctggcaagggactggagtggatcggcgagatcacccacagcggctccacaaactataatccttctctgaagagcagggtgtctatcagcgtggacacctctaagaaccagttcagcctgaagctgagctccgtgaccgcagcagatacagccgtgtactattgcgccagaggcgagtacggatccggatctcggtttgactattggggccagggcaccctggtgacagtgtctagcggaggaggaggaagcggaggaggagggtccggaggcgggggatctgccatccagatgacccagtccccatcctctctgagcgcctccgtgggcgatagggtggccctgacatgtagagccagccagggcatcagggacgatctgggctggtaccagcagaagccaggcaaggcccccaagctgctgatctatgcagcaagctccctgcagagcggagtgccatccagattctctggcagcggctccgacaccgacttcaccctgacaatctctagcctgcagcctgaggacttcgccacatactattgtctgcaggactacgattatccactgacctttggcggcggcacaaaggtggagatcaagaccacaactcctgcacctaggccacctaccccagcacctacaattgctagtcagccactgtcactgcgaccagaggcatgtcgacctgcagctggaggagcagtgcatacaaggggactggactttgcctgcgatatctacatttgggctcctctggcaggaacatgtggcgtgctgctgctgagcctggtcatcactctgtactgcaagcgaggccggaagaaactgctgtatattttcaaacagccctttatgcgacctgtgcagaccacacaggaggaagatgggtgctcctgtcggttccccgaggaagaggaaggaggctgtgagctgcgggtcaagttttccagatctgcagacgcccctgcttaccagcagggccagaaccagctgtataacgagctgaatctggggcggagagaggaatacgacgtgctggataaaaggcgcgggagagacccagaaatggggggaaagccacgacggaaaaacccccaggagggactgtacaatgaactgcagaaggataaaatggcagaggcctattccgaaatcgggatgaagggagaaagaaggcgaggcaaaggacacgacggactgtaccaggggctgtctaccgccacaaaggacacctatgatgctctgcatatgcaggcactgccacccagg

SEQ ID NO: 587 - DNA, 1458 bp, Artificial Sequence
  Description of Artificial Sequence: Synthetic polynucleotide
atggctctgcccgtcaccgctctgctgctgcctctggctctgctgctgcacgccgcacgaccacaggtgcagctgcagcagtggggagcaggactgctgaagccttctgagaccctgagcctgacatgcgccgtgtacggcggcagcttttccgcctactattggaactggatcaggcagccccctggcaagggactggagtggatcggcgagatcaatcactctggcagcaccaactataatcccagcctgaagtcccgcgtgaccatctccgtggacacatctaagaaccagttttctctgaatctgaccagcctgacagccgccgatacagccgtgtactattgcgccagaggcctggacagctccggatggtacccattcgattattggggccagggcaccctggtgacagtgtctagcggaggaggaggaagcggaggaggagggtccggaggcgggggatctgacatccagatgacccagtccccatccagcgtgagcgcctctgtgggcgatagggtgaccatcacatgtagagcaagccagggaatcagctcctggctggcatggtaccagcagaagccaggcaaggcccccaagctgctgatctatgcagcatctagcctgcagagcggagtgccatccaggtttagcggatccggatctggaaccgacttcaccctgacaatctcctctctgcagcctgaggacttcgccacatactattgtcagcaggccgattccttcccttttaccttcggcccaggcacaaaggtggatatcaagaccacaactcctgcacctaggccacctaccccagcacctacaattgctagtcagccactgtcactgcgaccagaggcatgtcgacctgcagctggaggagcagtgcatacaaggggactggactttgcctgcgatatctacatttgggctcctctggcaggaacatgtggcgtgctgctgctgagcctggtcatcactctgtactgcaagcgaggccggaagaaactgctgtatattttcaaacagccctttatgcgacctgtgcagaccacacaggaggaagatgggtgctcctgtcggttccccgaggaagaggaaggaggctgtgagctgcgggtcaagttttccagatctgcagacgcccctgcttaccagcagggccagaaccagctgtataacgagctgaatctggggcggagagaggaatacgacgtgctggataaaaggcgcgggagagacccagaaatggggggaaagccacgacggaaaaacccccaggagggactgtacaatgaactgcagaaggataaaatggcagaggcctattccgaaatcgggatgaagggagaaagaaggcgaggcaaaggacacgacggactgtaccaggggctgtctaccgccacaaaggacacctatgatgctctgcatatgcaggcactgccacccagg

SEQ ID NO: 588 - DNA, 1443 bp, Artificial Sequence
  Description of Artificial Sequence: Synthetic polynucleotide
atggctctgcccgtcaccgctctgctgctgcctctggctctgctgctgcacgccgcacgaccacaggtgcagctgcagcagtggggagcaggactgctgaagccaagcgagaccctgtccctgacatgcgccgtgttcggcggctcttttagcggcgactactggagctggatcaggcagccccctggcaagggactggagtggatcggcgagatcaaccactctggcatcaccagcttcaatccctccctgaagtctcgcgtgaccatctccgtggacacatctaagaaccagttttccctgaagctgagctccgtgaccgcagcagatacagccgtgtactattgcgccagaggcgagctgggcatccctgacaattggggccagggcaccctggtgacagtgtctagcggaggaggaggaagcggaggaggagggtccggaggcgggggatctgatatccagatgacccagtccccatctacactgagcgcctccgtgggcgatagggtgaccatcacatgtagagcctctcagagcatctcccggtggctggcctggtaccagcagaagccaggcaaggcccccaagctgctgatctataaggcatcctctctggagagcggagtgccatccaggttctctggaagcggatccggaaccgagtttaccctgacaatcagctccctgcagcctgacgatttcgccacatactattgtcagcagtacaactcttatagcacctttggccagggcacaaaggtggagatcaagaccacaactcctgcacctaggccacctaccccagcacctacaattgctagtcagccactgtcactgcgaccagaggcatgtcgacctgcagctggaggagcagtgcatacaaggggactggactttgcctgcgatatctacatttgggctcctctggcaggaacatgtggcgtgctgctgctgagcctggtcatcactctgtactgcaagcgaggccggaagaaactgctgtatattttcaaacagccctttatgcgacctgtgcagaccacacaggaggaagatgggtgctcctgtcggttccccgaggaagaggaaggaggctgtgagctgcgggtcaagttttccagatctgcagacgcccctgcttaccagcagggccagaaccagctgtataacgagctgaatctggggcggagagaggaatacgacgtgctggataaaaggcgcgggagagacccagaaatggggggaaagccacgacggaaaaacccccaggagggactgtacaatgaactgcagaaggataaaatggcagaggcctattccgaaatcgggatgaagggagaaagaaggcgaggcaaaggacacgacggactgtaccaggggctgtctaccgccacaaaggacacctatgatgctctgcatatgcaggcactgccacccagg

SEQ ID NO: 589 - DNA, 1485 bp, Artificial Sequence
  Description of Artificial Sequence: Synthetic polynucleotide
atggctctgcctgtcaccgctctgctgctgcctctggctctgctgctgcacgcggcgcgcccgcaggtgcagctgcaggagtccggccctggcctggtgaagccatccggcaccctgtctctgacatgcgtggtgttcggcgacagcatcagctcctctaactggtggtcctgggtgaggcagccccctggcaagggactggagtggatcggcgaggtgttccactccggctctaccaactacaatccaagcctgaagtcccgcgtgacaatcagcgtggataagtccaagaatcagtttagcctgaagctgagctccgtgaccgcagcagacacagccgtgtactattgcgccagagccgcagtggcaggcgccctggattattggggacagggcaccctggtgacagtgtctagcggcggcggcggctctggaggaggaggcagcggcggaggaggctccggaggcggcggctctgacatcgtgatgacccagtctcccgatagcctggccgtgtctctgggcgagagggcaacaatcaactgtaagtcctctcagagcgtgctgtacagctccaacaataagaactacctggcctggtatcagcagaagcctggccagccacccaatctgctggtgtattgggcctctaccagagagagcggagtgcctgacagattctccggagcaggatctggaacagacttcaccctgacaatctctagcctgcaggccgaggacgtggccgtgtactattgtcagcagtactatggcacctcctggacatttggccagggcaccaaggtggagatcaagaccacaaccccagcacctaggccacctacacctgcaccaaccatcgccagccagcctctgtccctgagaccagaggcctgtaggccagcagcaggaggagcagtgcacacccggggcctggacttcgcctgcgatatctacatctgggcaccactggcaggaacatgtggcgtgctgctgctgtccctggtcatcaccctgtactgcaagagaggcaggaagaagctgctgtatatcttcaagcagcccttcatgagacccgtgcagacaacccaggaggaggacggctgcagctgtaggttcccagaggaggaggagggaggatgtgagctgcgcgtgaagttttcccggtctgccgatgcacctgcataccagcagggacagaaccagctgtataacgagctgaatctgggccggagagaggagtacgacgtgctggataagaggaggggaagggaccctgagatgggaggcaagcctcggagaaagaacccacaggagggcctgtacaatgagctgcagaaggacaagatggccgaggcctatagcgagatcggcatgaagggagagaggcgccggggcaagggacacgatggcctgtatcagggcctgtcaaccgctacaaaagatacctacgatgctctgcacatgcaggctctgccaccaaga

SEQ ID NO: 590 - DNA, 1458 bp, Artificial Sequence
  Description of Artificial Sequence: Synthetic polynucleotide
atggctctgcccgtcaccgctctgctgctgcctctggctctgctgctgcacgccgcacgaccacagatcacactgagggagagcggccctaccctggtgaagccaacccagacactgaccctgacatgcaccttttccggcttctccctgtctaccagcggcctgggcgtgggatggatcaggcagccccctggcgaggccctggagtggctggccctgatctactggaacgacgataagcggtattccccctctctgaagtctagactgagcatcacaaaggacacctccaagaaccaggtggtgctgatcatgacaaatatggacccagtggatacagccacctactattgcgtgcacaggagaatcgcagcccctggcagcgtgtactggggacagggcacactggtgaccgtgagctccggaggaggaggaagcggaggaggagggtccggaggcgggggatctgacatccagatgacccagtctccttctagcgtgagcgcctccgtgggcgatagggtgacaatcacctgtcgcgccagccagggcatctcctcttggctggcctggtatcagcagaagccaggcaaggcaccaaagctgctgatcagcgccgcaagctccctgcagtccggagtgccatctcggttttctggcagcggctccggcacagacttcacactgaccatctctagcctgcagcccgaggattttgccacctactattgtcaccaggccaattccttcccttttacattcggccagggcaccaagctggagatcaagaccacaactcctgcacctaggccacctaccccagcacctacaattgctagtcagccactgtcactgcgaccagaggcatgtcgacctgcagctggaggagcagtgcatacaaggggactggactttgcctgcgatatctacatttgggctcctctggcaggaacatgtggcgtgctgctgctgagcctggtcatcactctgtactgcaagcgaggccggaagaaactgctgtatattttcaaacagccctttatgcgacctgtgcagaccacacaggaggaagatgggtgctcctgtcggttccccgaggaagaggaaggaggctgtgagctgcgggtcaagttttccagatctgcagacgcccctgcttaccagcagggccagaaccagctgtataacgagctgaatctggggcggagagaggaatacgacgtgctggataaaaggcgcgggagagacccagaaatggggggaaagccacgacggaaaaacccccaggagggactgtacaatgaactgcagaaggataaaatggcagaggcctattccgaaatcgggatgaagggagaaagaaggcgaggcaaaggacacgacggactgtaccaggggctgtctaccgccacaaaggacacctatgatgctctgcatatgcaggcactgccacccagg

SEQ ID NO: 591 - DNA, 1455 bp, Artificial Sequence
  Description of Artificial Sequence: Synthetic polynucleotide
atggctctgcccgtcaccgctctgctgctgcctctggctctgctgctgcacgccgcacgaccacaggtgcagctggtgcagtccggagcagaggtgaagaagcctggcgcctccgtgaaggtgtcttgcaaggtgagcggctacaccctgacagagctgtctatgcactgggtgcgccaggcccccggcaagggacctgagggaatgggaggattcgaccctgaggatggcaagacaatctacgcccagaagtttcagggccgggtgaccatgacagaggacaccagcgccgatacagcctatatggagctgaactctctgcgcagcgaggacaccgccgtgtactattgcgccacactgctgaggggactggacgccttcgacgtgtggggacagggaaccatggtgacagtgagctccggaggaggaggaagcggaggaggagggtccggaggcgggggatctgatatccagatgacccagtctccatctagcctgagcgcctccgtgggcgacagggtgaccatcacatgtagagccagccagggcatcaggaacgatctgggctggtaccagcagaagccaggcaaggcccccaagagactgatctatgcagcatcctctctgcagtccggagtgccatctaggttctctggcagcggctccggcaccgagtttaccctgacaatcagcacactgcagcctgaggacttcgccacctactattgtctgcagcacaattcctatccacggacctttggccagggcacaaaggtggagatcaagaccacaactcctgcacctaggccacctaccccagcacctacaattgctagtcagccactgtcactgcgaccagaggcatgtcgacctgcagctggaggagcagtgcatacaaggggactggactttgcctgcgatatctacatttgggctcctctggcaggaacatgtggcgtgctgctgctgagcctggtcatcactctgtactgcaagcgaggccggaagaaactgctgtatattttcaaacagccctttatgcgacctgtgcagaccacacaggaggaagatgggtgctcctgtcggttccccgaggaagaggaaggaggctgtgagctgcgggtcaagttttccagatctgcagacgcccctgcttaccagcagggccagaaccagctgtataacgagctgaatctggggcggagagaggaatacgacgtgctggataaaaggcgcgggagagacccagaaatggggggaaagccacgacggaaaaacccccaggagggactgtacaatgaactgcagaaggataaaatggcagaggcctattccgaaatcgggatgaagggagaaagaaggcgaggcaaaggacacgacggactgtaccaggggctgtctaccgccacaaaggacacctatgatgctctgcatatgcaggcactgccacccagg

SEQ ID NO: 592 - DNA, 1458 bp, Artificial Sequence
  Description of Artificial Sequence: Synthetic polynucleotide
atggctctgcccgtcaccgctctgctgctgcctctggctctgctgctgcacgccgcacgaccacaggtgcagctgcagcagtggggagcaggactgctgaagccatccgagaccctgtctctgacatgcgccgtgtatggcggctccttctctggctactattggcggtggatcagacagccccctggcaagggactggagtggatcggcgagatcagccactccggctctaccaactacaatccctctctgaagagccgcgtgaccatcagcgtggacacatccaagaaccagttcagcctgaagctgagctccgtgaccgcagcagatacagccgtgtactattgcgccgtgcggggctactcctatggctaccccctgtttgactactggggccagggcaccctggtgacagtgtctagcggaggaggaggaagcggaggaggagggtccggaggcgggggatctgatatccagatgacccagtccccttcctctctgagcgcctccgtgggcgacagggtgaccatcacatgtcgcgcctctcagggcatccggaacgatctgggctggtatcagcagaagctgggcaaggccccaaagagactgatctacgcagcaagctccctgcagtctggagtgccaagcaggttctctggaagcggatccggaaccgagtttaccctgacaatctctagcctgcagcctgaggacttcgccacatactattgtctgcagtataatagctacccacggacctttggccagggcacaaaggtggagatcaagaccacaactcctgcacctaggccacctaccccagcacctacaattgctagtcagccactgtcactgcgaccagaggcatgtcgacctgcagctggaggagcagtgcatacaaggggactggactttgcctgcgatatctacatttgggctcctctggcaggaacatgtggcgtgctgctgctgagcctggtcatcactctgtactgcaagcgaggccggaagaaactgctgtatattttcaaacagccctttatgcgacctgtgcagaccacacaggaggaagatgggtgctcctgtcggttccccgaggaagaggaaggaggctgtgagctgcgggtcaagttttccagatctgcagacgcccctgcttaccagcagggccagaaccagctgtataacgagctgaatctggggcggagagaggaatacgacgtgctggataaaaggcgcgggagagacccagaaatggggggaaagccacgacggaaaaacccccaggagggactgtacaatgaactgcagaaggataaaatggcagaggcctattccgaaatcgggatgaagggagaaagaaggcgaggcaaaggacacgacggactgtaccaggggctgtctaccgccacaaaggacacctatgatgctctgcatatgcaggcactgccacccagg

SEQ ID NO: 593 - DNA, 1443 bp, Artificial Sequence
  Description of Artificial Sequence: Synthetic polynucleotide
atggctctgcccgtcaccgctctgctgctgcctctggctctgctgctgcacgccgcacgaccacaggtgcagctgcaggagagcggccctggcctggtgaagccatccggcaccctgtctctgacatgcgccgtgagcggcgactccatcagctccaactggtggacatgggtgaggcagccccctggcaagggactggagtggatcggcgatatccaccactccggctctaccaactacaatccatctctgaagagccgcgtgacaatgagcgtggacaagtccgagaatcagttctccctgaagctgtctagcgtgaccgccgccgatacagccgtgttttactgcgccagagacggaggaggcaccctggattattggggccagggcaccctggtgacagtgtcctctggaggaggaggaagcggaggaggagggtccggaggcgggggatctgacatccagatgacccagagcccatccacactgtctgccagcgtgggcgatcgggtgaccatcacatgtagagcctcccagtctatcagctcctggctggcctggtaccagcagaagccaggcaaggcccccaagctgctgatctataaggcatctaccctggagagcggagtgccatccaggttcagcggatccggatctggcacagagtttaccctgacaatctctagcctgcagcctgacgatttcgccacctactattgtcagcagtacaacggctatagcacctttggccagggcacaaaggtggagatcaagaccacaactcctgcacctaggccacctaccccagcacctacaattgctagtcagccactgtcactgcgaccagaggcatgtcgacctgcagctggaggagcagtgcatacaaggggactggactttgcctgcgatatctacatttgggctcctctggcaggaacatgtggcgtgctgctgctgagcctggtcatcactctgtactgcaagcgaggccggaagaaactgctgtatattttcaaacagccctttatgcgacctgtgcagaccacacaggaggaagatgggtgctcctgtcggttccccgaggaagaggaaggaggctgtgagctgcgggtcaagttttccagatctgcagacgcccctgcttaccagcagggccagaaccagctgtataacgagctgaatctggggcggagagaggaatacgacgtgctggataaaaggcgcgggagagacccagaaatggggggaaagccacgacggaaaaacccccaggagggactgtacaatgaactgcagaaggataaaatggcagaggcctattccgaaatcgggatgaagggagaaagaaggcgaggcaaaggacacgacggactgtaccaggggctgtctaccgccacaaaggacacctatgatgctctgcatatgcaggcactgccacccagg

SEQ ID NO: 594 - DNA, 1485 bp, Artificial Sequence
  Description of Artificial Sequence: Synthetic polynucleotide
atggcactgccagtgaccgccctgctgctgcctctggccctgctgctgcacgccgccaggcctcaggtgcagctggtgcagtctggcgccgaggtgaagaagccaggcagctccgtgaaggtgtcctgcaaggcctctggcggcacattcaccaactattgtatcagctgggtgagacaggccccaggccagggactggagtggatgggaggaatcatccccatcttcggcaccacaaattatgcccagacctttcagggccgggtgacaatcaccgccgacaagtctacaagcaccgcctacatggagctgtctagcctgagatccgaggatacagccgtgtactattgcgccagagacaacggcgatagatactattacgacatggacgtgtggggccagggcaccacagtgaccgtgtcctctggaggaggaggcagcggcggaggaggctccggaggcggcggctctggcggcggcggctcccagtctgtgctgacacagccacctagcgtgtccgccgcccctggccagaaggtgaccatctcttgtagcggcagctcctctaatatcggcaacaattacgtgagctggtaccagcagctgccaggcacagcccccaagctgctgatctacgacaacaataagaggcctagcggcatcccagatcgcttctccggctctaagagcggcacatccgccaccctgggcatcacaggactgcagaccggcgacgaggcagattattactgcggaacctgggacagctccctgagcgccgtggtgtttggaggaggcacaaagctgaccgtgctgaccacaacccctgcccctaggccacctaccccagcacctacaattgctagtcagccactgtcactgcgaccagaggcatgtcgacctgcagctggaggagcagtgcatacaaggggactggactttgcctgcgatatctacatttgggctcctctggcaggaacatgtggcgtgctgctgctgagcctggtcatcactctgtactgcaagcgaggccggaagaaactgctgtatattttcaaacagccctttatgcgacctgtgcagaccacacaggaggaagatgggtgctcctgtcggttccccgaggaagaggaaggaggctgtgagctgcgggtcaagttttccagatctgcagacgcccctgcttaccagcagggccagaaccagctgtataacgagctgaatctggggcggagagaggaatacgacgtgctggataaaaggcgcgggagagacccagaaatggggggaaagccacgacggaaaaacccccaggagggactgtacaatgaactgcagaaggataaaatggcagaggcctattccgaaatcgggatgaagggagaaagaaggcgaggcaaaggacacgacggactgtaccaggggctgtctaccgccacaaaggacacctatgatgctctgcatatgcaggcactgccacccagg

SEQ ID NO: 595 - DNA, 1491 bp, Artificial Sequence
  Description of Artificial Sequence: Synthetic polynucleotide
atggccctgccagtgaccgccctgctgctgccactggccctgctgctgcacgccgcccggccacaggtgcccctggtgcagagcggagcagaggtgaagaagcccggcagctccgtgaaggtgagctgcaaggcctccggcggcacattctccacctattctatcagctgggtgcggcaggcccctggccagggactggagtggatgggaggaatcatcccaatcttcggcaccacaaactatgcccagaagtttcagggcagggtgacaatcaccgccgacaagtccacatctaccgcctacatggagctgtctagcctgaggtccgaggacacagccgtgtactattgtgcccgcgatggcgagggctcttactattactattacggaatggacgtgtggggacagggaaccacagtgaccgtgtcctctggcggcggcggctctggaggaggaggcagcggcggaggaggctccggaggcggcggcagccagtccgtgctgacacagccaccttctgtgagcgccgcccctggccagaaggtgaccatctcctgctctggcagctcctctaatatcggcaacaattatgtgagctggtaccagcagctgcctggcacagccccaaagctgctgatctacgacaacaataagcggccctccggcatccctgatagattctttggctctaagttcggcacaagcgccaccctgggcatcacaggactgcagaccggcgacgaggcagattattactgtggaacctgggacagctccctgagcgccgtggtgtttggaggaggcacaaagctgaccgtgctgaccacaacccctgcccctaggccacctaccccagcacctacaattgctagtcagccactgtcactgcgaccagaggcatgtcgacctgcagctggaggagcagtgcatacaaggggactggactttgcctgcgatatctacatttgggctcctctggcaggaacatgtggcgtgctgctgctgagcctggtcatcactctgtactgcaagcgaggccggaagaaactgctgtatattttcaaacagccctttatgcgacctgtgcagaccacacaggaggaagatgggtgctcctgtcggttccccgaggaagaggaaggaggctgtgagctgcgggtcaagttttccagatctgcagacgcccctgcttaccagcagggccagaaccagctgtataacgagctgaatctggggcggagagaggaatacgacgtgctggataaaaggcgcgggagagacccagaaatggggggaaagccacgacggaaaaacccccaggagggactgtacaatgaactgcagaaggataaaatggcagaggcctattccgaaatcgggatgaagggagaaagaaggcgaggcaaaggacacgacggactgtaccaggggctgtctaccgccacaaaggacacctatgatgctctgcatatgcaggcactgccacccagg

SEQ ID NO: 596 - DNA, 1470 bp, Artificial Sequence
  Description of Artificial Sequence: Synthetic polynucleotide
atggcactgccagtgacagccctgctgctgcctctggccctgctgctgcacgccgcccggccacaggtgcagctgcaggagtccggccctggcctggtgaagccatctgagaccctgagcctgacatgtaccgtgtccggcgattctatcagctcctactattggtcttggatcaggcagccccctggcaagggactggagtggatcggctacatgtactatagcggcatcacaaactataatcctagcctgaagtcccgcgtgaacatctccctggacacctctaagaatcagttcagcctgaagctgggctccgtgacagcagcagataccgccgtgtactattgcgcaaggctgtccgtggcaggcttctactttgactattggggccagggcacactggtgaccgtgtctagcggcggcggcggctctggaggaggaggcagcggcggaggaggctccggcggcggcggctctgagatcgtgctgacacagagcccaggcaccctgagcctgtcccccggcgagcgggccacactgagctgtagagcctctcagagcgtgacccggtcctacctggcctggtatcagcagaagccaggccaggcccccagactgctgatctacggcgcctcctctagggccacagacatcccagatcgcttctccggctctggcagcggaaccgactttacactgaccatcaacagactggagcctgaggatttcgccgtgtactattgccagcagtacggcacaagcccactgacctttggcggcggcaccaaggtggagatcaagaccacaacccctgcccctaggccacctaccccagcacctacaattgctagtcagccactgtcactgcgaccagaggcatgtcgacctgcagctggaggagcagtgcatacaaggggactggactttgcctgcgatatctacatttgggctcctctggcaggaacatgtggcgtgctgctgctgagcctggtcatcactctgtactgcaagcgaggccggaagaaactgctgtatattttcaaacagccctttatgcgacctgtgcagaccacacaggaggaagatgggtgctcctgtcggttccccgaggaagaggaaggaggctgtgagctgcgggtcaagttttccagatctgcagacgcccctgcttaccagcagggccagaaccagctgtataacgagctgaatctggggcggagagaggaatacgacgtgctggataaaaggcgcgggagagacccagaaatggggggaaagccacgacggaaaaacccccaggagggactgtacaatgaactgcagaaggataaaatggcagaggcctattccgaaatcgggatgaagggagaaagaaggcgaggcaaaggacacgacggactgtaccaggggctgtctaccgccacaaaggacacctatgatgctctgcatatgcaggcactgccacccagg

SEQ ID NO: 597 - DNA, 1470 bp, Artificial Sequence
  Description of Artificial Sequence: Synthetic polynucleotide
atggcactgccagtgacagccctgctgctgcctctggccctgctgctgcacgccgcccggccacaggtgcagctgcaggagagcggccctggcctggtgaagccatctgagaccctgagcctgacatgtaccgtgagctccgattccatctctagctactattggtcttggatcagacagccccctggcaagggcctggagtggatctcctacatctactattccggcatctctaactataatcctagcctgaagagccgggtgagcatctctgtggacacctccaagaaccagttttctctgagactgtcctctgtgacagccgccgataccgccgtgtactattgcgccagaatcagcgtggccggcttctttttcgacaattggggccagggcacactggtgaccgtgagctccggaggaggaggcagcggaggaggaggctccggaggcggcggctctggcggcggcggcagcgagatcatgctgacacagagcccagataccctgagcctgtcccccggcgaaagggccacactgtcctgtagagcctctcagagcgtgtctagctcctacctggcctggtatcagcagaagccaggccaggcacccaggctgctgatctacggagcatctagcagggccgcaggagtgccagaccgcttttccggctctggcagcggcaccgatttcacactgaccatctctcgcctggcccctgaggactttgtggtgtactattgccagcagtatggcatctccccactgacattcggcggcggcaccaaggtggagatcaagaccacaacccctgcccctaggccacctaccccagcacctacaattgctagtcagccactgtcactgcgaccagaggcatgtcgacctgcagctggaggagcagtgcatacaaggggactggactttgcctgcgatatctacatttgggctcctctggcaggaacatgtggcgtgctgctgctgagcctggtcatcactctgtactgcaagcgaggccggaagaaactgctgtatattttcaaacagccctttatgcgacctgtgcagaccacacaggaggaagatgggtgctcctgtcggttccccgaggaagaggaaggaggctgtgagctgcgggtcaagttttccagatctgcagacgcccctgcttaccagcagggccagaaccagctgtataacgagctgaatctggggcggagagaggaatacgacgtgctggataaaaggcgcgggagagacccagaaatggggggaaagccacgacggaaaaacccccaggagggactgtacaatgaactgcagaaggataaaatggcagaggcctattccgaaatcgggatgaagggagaaagaaggcgaggcaaaggacacgacggactgtaccaggggctgtctaccgccacaaaggacacctatgatgctctgcatatgcaggcactgccacccagg

SEQ ID NO: 598 - DNA, 1494 bp, Artificial Sequence
  Description of Artificial Sequence: Synthetic polynucleotide
atggctctgcctgtcaccgctctgctgctgcctctggctctgctgctgcacgcggcgcgcccgcaggtgcagctgcagcagagcggccctggcctggtgaagcctagccagacactgtccctgacctgtgccatctctggcgacagcgtgagctccaacagcgccacatggaattggatcaggcagtccccatctcgcggcctggagtggctgggacggacctactatagatccaagtggtacgacgattatgccgtgtccgtgaagtctcgcatcacaatcaaccctgacacctccaagaatcacctgtctctgcacctgaacagcgtgacaccagaggataccgccgtgtactattgcgcaggaggaggactggtgggcgcccctgacggattcgacgtgtggggccagggcacaatggtgaccgtgtctagcggcggcggcggctctggaggaggaggcagcggcggaggaggctccggaggcggcggctctcagtccgtgctgacacagcccccttctgccagcggaacacccggccagcgggtgaccatctcctgttctggctcctctagcaacatcggctccgaccctgtgaattggtaccagcagctgccaggcacagcccccaagctgctgatctatagcaacaatcagcggccttccggcgtgccagatagattcagcggctccaagtctggcaccagcgcctccctggcaatctctggactgcagagcgaggacgaggccgattactattgctccgcctgggacgattctctgaatggctacgtgtttggcacaggcaccaaggtgaccgtgctgaccacaaccccagcacctaggccacctacacctgcaccaaccatcgccagccagcctctgtccctgagaccagaggcctgtaggccagcagcaggaggagcagtgcacacccggggcctggacttcgcctgcgatatctacatctgggcaccactggcaggaacatgtggcgtgctgctgctgtccctggtcatcaccctgtactgcaagagaggcaggaagaagctgctgtatatcttcaagcagcccttcatgagacccgtgcagacaacccaggaggaggacggctgcagctgtaggttcccagaggaggaggagggaggatgtgagctgcgcgtgaagttttcccggtctgccgatgcacctgcataccagcagggacagaaccagctgtataacgagctgaatctgggccggagagaggagtacgacgtgctggataagaggaggggaagggaccctgagatgggaggcaagcctcggagaaagaacccacaggagggcctgtacaatgagctgcagaaggacaagatggccgaggcctatagcgagatcggcatgaagggagagaggcgccggggcaagggacacgatggcctgtatcagggcctgtcaaccgctacaaaagatacctacgatgctctgcacatgcaggctctgccaccaaga

SEQ ID NO: 599 - DNA, 1479 bp, Artificial Sequence
  Description of Artificial Sequence: Synthetic polynucleotide
atggctctgcctgtcaccgctctgctgctgcctctggctctgctgctgcacgcggcgcgcccgcaggtgcagctggtgcagagcggagcagaggtgaagaagcctggcgccagcgtgaaggtgtcctgcaaggcctctggctacacattcaccggctattctatccactgggtgcgccaggcccctggccagggactggagtggatgggctggatcaacccaaatagcggcggcaccttctacgcccagaagtttcagggcagggtgacaatgacccgcgacacatctatcagcaccgtgtatatggagctgagccggctgagatccgacgatacagccgtgtactattgtgccagagacggctggggcgattactattactatggactggacgtgtggggacagggaaccacagtgaccgtgtccctgggcggcggcggctctggaggaggaggcagcggcggaggaggctccggaggcggcggctctgatatccagatgacacagagccctagctccgtgtccgcctctgtgggcgacagggtgacaatcacctgcagagcctcccaggatatctctagctggctggcctggtaccagcagaagcccggcaaggcccctaagctgctgatctataccgcatcctctctgcagggaggagtgccatcccggttcagcggctccggctctggaacagactttacactgaccatcagctccctgcagccagaggatctggccacctactcttgtcagcaggccaacgtgttcccctatacatttggccagggcaccaagctggagatcaagaccacaaccccagcacctaggccacctacacctgcaccaaccatcgccagccagcctctgtccctgagaccagaggcctgtaggccagcagcaggaggagcagtgcacacccggggcctggacttcgcctgcgatatctacatctgggcaccactggcaggaacatgtggcgtgctgctgctgtccctggtcatcaccctgtactgcaagagaggcaggaagaagctgctgtatatcttcaagcagcccttcatgagacccgtgcagacaacccaggaggaggacggctgcagctgtaggttcccagaggaggaggagggaggatgtgagctgcgcgtgaagttttcccggtctgccgatgcacctgcataccagcagggacagaaccagctgtataacgagctgaatctgggccggagagaggagtacgacgtgctggataagaggaggggaagggaccctgagatgggaggcaagcctcggagaaagaacccacaggagggcctgtacaatgagctgcagaaggacaagatggccgaggcctatagcgagatcggcatgaagggagagaggcgccggggcaagggacacgatggcctgtatcagggcctgtcaaccgctacaaaagatacctacgatgctctgcacatgcaggctctgccaccaaga

SEQ ID NO: 600 - DNA, 1479 bp, Artificial Sequence
  Description of Artificial Sequence: Synthetic polynucleotide
atggctctgcctgtcaccgctctgctgctgcctctggctctgctgctgcacgcggcgcgcccggaggtgcagctgctggagtccggcggcggcctggtgcagccaggcggctctctgaggctgagctgcgcagcatccggcttcacctttagctcctacgcaatgaactgggtgcgccaggcccccggcaagggactggagtgggtgtctacaatctctggcagcggcggcagcacctactatgccgactccgtgaagggccggttcacaatctctagagataacagcaagaataccctgtacctgcagatgaacagcctgcgggccgaggacacagccgtgttttattgtgccatcgacccagagtactatgatatcctgaccggcggcgattattggggccagggcacactggtgaccgtgtctagcggcggcggcggctctggaggaggaggcagcggcggaggaggctccggaggcggcggctctgacatccagatgacccagtccccatctgccatgagcgcctccgtgggcgatagggtgacaatcacctgccgcgcctcccagggcatctctaactacctggcctggttccagcagaagcccggcaaggtgcctaagcggctgatctatgcagcatcctctctgcagagcggagtgccttccagattctctggcagcggctccggcacagagtttacactgaccatcagctccctgcagcccgaggacttcgccacctacttttgtctgcagcacgattccttccctctgacatttggcggcggcaccaaggtggagatcaagaccacaaccccagcacctaggccacctacacctgcaccaaccatcgccagccagcctctgtccctgagaccagaggcctgtaggccagcagcaggaggagcagtgcacacccggggcctggacttcgcctgcgatatctacatctgggcaccactggcaggaacatgtggcgtgctgctgctgtccctggtcatcaccctgtactgcaagagaggcaggaagaagctgctgtatatcttcaagcagcccttcatgagacccgtgcagacaacccaggaggaggacggctgcagctgtaggttcccagaggaggaggagggaggatgtgagctgcgcgtgaagttttcccggtctgccgatgcacctgcataccagcagggacagaaccagctgtataacgagctgaatctgggccggagagaggagtacgacgtgctggataagaggaggggaagggaccctgagatgggaggcaagcctcggagaaagaacccacaggagggcctgtacaatgagctgcagaaggacaagatggccgaggcctatagcgagatcggcatgaagggagagaggcgccggggcaagggacacgatggcctgtatcagggcctgtcaaccgctacaaaagatacctacgatgctctgcacatgcaggctctgccaccaaga

SEQ ID NO: 601 - DNA, 1470 bp, Artificial Sequence
  Description of Artificial Sequence: Synthetic polynucleotide
atggctctgcctgtcaccgctctgctgctgcctctggctctgctgctgcacgcggcgcgcccgcaggtgcagctgcaggagtccggccctggcctggtgaagccaagcgagaccctgtccctgacatgtaccgtgagctccgattctatcagcaactactattggagctggatcaggcagccccctggcaagggactggagtggatctcctacatctactattctggcatcaccaactataatccttccctgaagtctcgcgtgacaatctctgtggacaccagcaagaatcagttcagcctgaagctgtctagcgtgacagccgccgataccgccgtgtactattgcgcccggatcacagtgaccggcttctactttgactattggggccagggcacactggtgaccgtgtcctctggcggcggcggctctggaggaggaggcagcggcggaggaggctccggaggcggcggctctgagatcgtgctgacacagtccccaggcaccctgtccctgtctcccggcgagcgggccacactgtcttgtagagccagccagtccatctctcggagctacctggcctggtatcagcagaagccaggccaggcccccagacacctgatctacggagcaagctccagggccaccggcatccccgaccgcttctccggctctggcagcggcacagacttcatcctgaccatctccagactggagcctgaggacttcgccgtgtactattgccagcagtacgatacaagcccactgacctttggcggcggcaccaaggtggagatcaagaccacaaccccagcacctaggccacctacacctgcaccaaccatcgccagccagcctctgtccctgagaccagaggcctgtaggccagcagcaggaggagcagtgcacacccggggcctggacttcgcctgcgatatctacatctgggcaccactggcaggaacatgtggcgtgctgctgctgtccctggtcatcaccctgtactgcaagagaggcaggaagaagctgctgtatatcttcaagcagcccttcatgagacccgtgcagacaacccaggaggaggacggctgcagctgtaggttcccagaggaggaggagggaggatgtgagctgcgcgtgaagttttcccggtctgccgatgcacctgcataccagcagggacagaaccagctgtataacgagctgaatctgggccggagagaggagtacgacgtgctggataagaggaggggaagggaccctgagatgggaggcaagcctcggagaaagaacccacaggagggcctgtacaatgagctgcagaaggacaagatggccgaggcctatagcgagatcggcatgaagggagagaggcgccggggcaagggacacgatggcctgtatcagggcctgtcaaccgctacaaaagatacctacgatgctctgcacatgcaggctctgccaccaaga

SEQ ID NO: 602 - DNA, 1494 bp, Artificial Sequence
  Description of Artificial Sequence: Synthetic polynucleotide
atggcactgccagtgacagccctgctgctgccactggccctgctgctgcacgccgcccggccacaggtgcagctgcagcagagcggccctggcctggtgaagcctagccagacactgtccctgacctgtgccatctctggcgacagcgtgagctccaacagcgtggtgtggaattggatcaggcagtccccatctcgcggcctggagtggctgggacggacctactatagatccaagtggtacgacgattatgccgtgtccgtgaagtctaggatcacaatcaaccctgacaccagcaagaatcagttctccctgcagctgaactctgtgacaccagaggataccgccgtgtaccactgcgccagaggcggaatcgtgggcgcccctgacgcctttgatatctggggccagggcacaatggtgaccgtgtctagcggaggaggaggcagcggaggaggaggctccggaggcggcggctctggcggcggcggcagccagtccgtgctgacccagccaccttctgccagcggaacacccggccagcgggtgaccatctcctgttctggctcctctagcaacatcggctctgaccctgtgagctggtaccagcagttcccaggcacagcccccaagctgctgatctataccaacaatcagcggcctagcggcgtgccagatcggttcagcggctccaagtctggcacaagcgcctccctggcaatctccggactgcagtctgaggacgaggccgattactattgcgccgcctgggacgattccctgaatggccacgtgttcggcacaggcaccaaggtgaccgtgctgaccacaacccccgcccctaggccacctaccccagcacctacaattgctagtcagccactgtcactgcgaccagaggcatgtcgacctgcagctggaggagcagtgcatacaaggggactggactttgcctgcgatatctacatttgggctcctctggcaggaacatgtggcgtgctgctgctgagcctggtcatcactctgtactgcaagcgaggccggaagaaactgctgtatattttcaaacagccctttatgcgacctgtgcagaccacacaggaggaagatgggtgctcctgtcggttccccgaggaagaggaaggaggctgtgagctgcgggtcaagttttccagatctgcagacgcccctgcttaccagcagggccagaaccagctgtataacgagctgaatctggggcggagagaggaatacgacgtgctggataaaaggcgcgggagagacccagaaatggggggaaagccacgacggaaaaacccccaggagggactgtacaatgaactgcagaaggataaaatggcagaggcctattccgaaatcgggatgaagggagaaagaaggcgaggcaaaggacacgacggactgtaccaggggctgtctaccgccacaaaggacacctatgatgctctgcatatgcaggcactgccacccagg

SEQ ID NO: 603 - DNA, 1494 bp, Artificial Sequence
  Description of Artificial Sequence: Synthetic polynucleotide
atggccctgccagtgaccgccctgctgctgccactggccctgctgctgcacgccgcccggccacaggtgcagctgcagcagtccggccctggcctggtgaagccttctcagacactgagcctgacctgtgccatctccggcgactctgtgagctccaactctgccgtgtggaattggatcagacagtccccctctagaggcctggagtggctgggctggacatactatcggagcaagtactataacgactacgccgtgagcctgaagtccagaatcacaatcaaccctgataccagcaagaatcagttctccctgcagctgaacagcctgacaccagaggataccgccgtgtactattgcaccaggggcggaatcgtgggcgcccctgacggctttgatatctggggccagggcacaatggtgaccgtgtctagcggaggaggaggcagcggaggaggaggctccggaggcggcggctctggcggcggcggcagccagtccgccctgacacagccaccttctgccagcggaacacccggccagcgcgtgaccatctcctgttctggcagcaactccaatatcggctccaaccctatcaattggtaccagcagctgccaggcacagcccccaagctgctgatctatagcaacaatcagaggccttccggcgtgccagaccgcttctctggcagcaagtccggcacctctgccagcctggcaatctccggactgcagtctgaggacgaggccgattactattgcgcagcatgggacgatagcctgaacggacacgtgtttggcacaggcaccaaggtgaccgtgctgaccacaacccccgcccctaggccacctaccccagcacctacaattgctagtcagccactgtcactgcgaccagaggcatgtcgacctgcagctggaggagcagtgcatacaaggggactggactttgcctgcgatatctacatttgggctcctctggcaggaacatgtggcgtgctgctgctgagcctggtcatcactctgtactgcaagcgaggccggaagaaactgctgtatattttcaaacagccctttatgcgacctgtgcagaccacacaggaggaagatgggtgctcctgtcggttccccgaggaagaggaaggaggctgtgagctgcgggtcaagttttccagatctgcagacgcccctgcttaccagcagggccagaaccagctgtataacgagctgaatctggggcggagagaggaatacgacgtgctggataaaaggcgcgggagagacccagaaatggggggaaagccacgacggaaaaacccccaggagggactgtacaatgaactgcagaaggataaaatggcagaggcctattccgaaatcgggatgaagggagaaagaaggcgaggcaaaggacacgacggactgtaccaggggctgtctaccgccacaaaggacacctatgatgctctgcatatgcaggcactgccacccagg

SEQ ID NO: 604 - DNA, 1470 bp, Artificial Sequence
  Description of Artificial Sequence: Synthetic polynucleotide
atggcactgcctgtgacagccctgctgctgccactggccctgctgctgcacgccgcccggccccaggtgcagctgcaggagagcggcccaggcctggtgaagccaagcgagaccctgtccctgacatgtaccgtgtctggcggcagcatcagctcctactattggtcctggatcagacagtctcctggcaagggcctggagtggatcggctacgtgtactattccgacatcaccaactataatccatccctgaagtctagagtgacaatctctgtggataccagcaagaaccagttcagcctgaacctgaacagcgtgacagccgccgacaccgccttctacttttgcgccaggatcggcgtggccggcttctactttgattattggggccagggcacactggtgaccgtgtctagcggcggcggcggctctggaggaggaggcagcggcggaggaggctccggcggcggcggctctgagatcgtgctgacacagagcccagacaccctgagcctgtcccctggcgagagggccacactgtcctgtagggcatctcagagcgtgtcccggagatacctggcctggtatcagcagaagcctggccaggcacctcgcctgctgatctacggagcatcctctcgggccacaggcatccccgacagattctctggcagcggctccggaaccgacttcaccctgaccatctctaggctggagccagaggatttcgaggtgtactattgccagcagtatggcacatccccaatcacctttggccagggaacccgcctggagatcaagaccacaacccctgcccctaggccacctaccccagcacctacaattgctagtcagccactgtcactgcgaccagaggcatgtcgacctgcagctggaggagcagtgcatacaaggggactggactttgcctgcgatatctacatttgggctcctctggcaggaacatgtggcgtgctgctgctgagcctggtcatcactctgtactgcaagcgaggccggaagaaactgctgtatattttcaaacagccctttatgcgacctgtgcagaccacacaggaggaagatgggtgctcctgtcggttccccgaggaagaggaaggaggctgtgagctgcgggtcaagttttccagatctgcagacgcccctgcttaccagcagggccagaaccagctgtataacgagctgaatctggggcggagagaggaatacgacgtgctggataaaaggcgcgggagagacccagaaatggggggaaagccacgacggaaaaacccccaggagggactgtacaatgaactgcagaaggataaaatggcagaggcctattccgaaatcgggatgaagggagaaagaaggcgaggcaaaggacacgacggactgtaccaggggctgtctaccgccacaaaggacacctatgatgctctgcatatgcaggcactgccacccagg

SEQ ID NO: 605 - DNA, 1494 bp, Artificial Sequence
  Description of Artificial Sequence: Synthetic polynucleotide
atggccctgccagtgaccgccctgctgctgccactggccctgctgctgcacgccgcccggccacagatccagctgcagcagtccggccctggcctggtgaagcctagccagacactgtccctgacctgcgccatctctggcgacagcgtgagctccaactctgccgtgtggaattggatcaggcagtccccatctcgcggcctggagtggctgggaaggacatactatagaagcaagtggtacaacgactatgccgtgtccgtgaagtctaggatcacaatcaagcctgataccgccaagaaccagttctccctgcagctgaacagcgtgacaccagaggataccgccgtgtactatttcacccgcggcggaatcgtgggcgcccctgacgcctttgatatctggggccagggcacaatggtgaccgtgtctagcggaggaggaggcagcggaggaggaggctccggaggcggcggctctggcggcggcggcagccagtccgtgctgacacagcccccttctgccagcggaacacccggccagcgggtgaccatctcctgctctggctcctctagcaacatcggctccgaccctatcaattggtaccagcaggtgccaggcacagcccccaagctgctgatctatagcaacaatcagcggccttccggcgtgccagatagattcagcggctccaagtctggcaccagcgcctccctggcaatctctggactgcagagcgaggacgaggccgattactattgtgccgcctgggacgatagcctgaatggctacgtgtttggcacaggcaccaaggtgaccgtgctgaccacaacccccgcccctaggccacctaccccagcacctacaattgctagtcagccactgtcactgcgaccagaggcatgtcgacctgcagctggaggagcagtgcatacaaggggactggactttgcctgcgatatctacatttgggctcctctggcaggaacatgtggcgtgctgctgctgagcctggtcatcactctgtactgcaagcgaggccggaagaaactgctgtatattttcaaacagccctttatgcgacctgtgcagaccacacaggaggaagatgggtgctcctgtcggttccccgaggaagaggaaggaggctgtgagctgcgggtcaagttttccagatctgcagacgcccctgcttaccagcagggccagaaccagctgtataacgagctgaatctggggcggagagaggaatacgacgtgctggataaaaggcgcgggagagacccagaaatggggggaaagccacgacggaaaaacccccaggagggactgtacaatgaactgcagaaggataaaatggcagaggcctattccgaaatcgggatgaagggagaaagaaggcgaggcaaaggacacgacggactgtaccaggggctgtctaccgccacaaaggacacctatgatgctctgcatatgcaggcactgccacccagg

SEQ ID NO: 606 - DNA, 1494 bp, Artificial Sequence
  Description of Artificial Sequence: Synthetic polynucleotide
atggccctgccagtgaccgccctgctgctgccactggccctgctgctgcacgccgcccggccacaggtgcagctgcagcagagcggccctggcctggtgaagcctagcgagacactgtccctgacctgtgccatctctggcgacagcgtgagctccaacagcgccacatggaattggatcaggcagtccccatctcgcggcctggagtggctgggacggacctactatagatccgagtggtacaacgactatgccgtgtccgtgaagtctcggatcacaatcaaccctgatacctccaagaatcacctgtctctgcacctgaatagcgtgacaccagaggataccgccgtgtactattgcgcaggaggaggaatcgtgggcgcccctgacggattcgacgtgtggggccagggcacaatggtgaccgtgtctagcggaggaggaggctccggaggaggaggctctggcggcggcggcagcggaggcggcggcagccagtccgtgctgacacagccaccttctgccagcggaacacccggccagagggtgaccatctcctgttctggctcctctagcaacatcggcagcgaccctgtgatctggtaccagcagctgccacgcacagcccccaagctgctgatctattccaacaatcagcggccttctggcgtgccagatagattcagcggctccaagtctggcaccagcgcctccctggcaatctctggactgcagagcgaggacgaggccgattactattgcgccgcctgggacgattccctgaatggctacgtgtttggcacaggcaccaaggtgaccgtgctgaccacaacccccgcccctaggccacctaccccagcacctacaattgctagtcagccactgtcactgcgaccagaggcatgtcgacctgcagctggaggagcagtgcatacaaggggactggactttgcctgcgatatctacatttgggctcctctggcaggaacatgtggcgtgctgctgctgagcctggtcatcactctgtactgcaagcgaggccggaagaaactgctgtatattttcaaacagccctttatgcgacctgtgcagaccacacaggaggaagatgggtgctcctgtcggttccccgaggaagaggaaggaggctgtgagctgcgggtcaagttttccagatctgcagacgcccctgcttaccagcagggccagaaccagctgtataacgagctgaatctggggcggagagaggaatacgacgtgctggataaaaggcgcgggagagacccagaaatggggggaaagccacgacggaaaaacccccaggagggactgtacaatgaactgcagaaggataaaatggcagaggcctattccgaaatcgggatgaagggagaaagaaggcgaggcaaaggacacgacggactgtaccaggggctgtctaccgccacaaaggacacctatgatgctctgcatatgcaggcactgccacccagg

SEQ ID NO: 607 - DNA, 1494 bp, Artificial Sequence
  Description of Artificial Sequence: Synthetic polynucleotide
atggcactgccagtgacagccctgctgctgccactggccctgctgctgcacgccgcccggccacaggtgcagctgcagcagagcggccctggcctggtgaagcctagccagacactgtccctgacctgtgccatctctggcgacagcgtgagctccaacagcgccacctggaattggatcaggcagtccccatctacaggactggagtggctggcacggacctactatagatccaagtggtacaacgactatgaggtgtccgtgaagtctcagatcacaatcaaccctgatacctccaagaatcagttctctctgcagctgaatagcgtgacaccagaggataccgccgtgtactattgcgccagaggcggaatcgtgggcgcccctgacgcctttgatatctggggccagggcacaatggtgaccgtgtctagcggaggaggaggctccggaggaggaggctctggcggcggcggcagcggaggcggcggcagccagtccgtgctgacacagcccccttctgccagcggaacacccggccagggagtgaccatctcctgttctggctcctctagcaacatcggcagcaaccctgtgaattggtaccagcagctgccaggcacagcccccaagctgctgatctattccaacaatcagaggccttctggcgtgccagaccgcttcagcgattccaagtctggcaccagcgcctccctggcaatctctggactgcagagcgaggacgaggccgattactattgctccgcctgggacgattggctgaatggctacgtgtttggcacaggcaccaaggtgaccgtgctgaccacaacccccgcccctaggccacctaccccagcacctacaattgctagtcagccactgtcactgcgaccagaggcatgtcgacctgcagctggaggagcagtgcatacaaggggactggactttgcctgcgatatctacatttgggctcctctggcaggaacatgtggcgtgctgctgctgagcctggtcatcactctgtactgcaagcgaggccggaagaaactgctgtatattttcaaacagccctttatgcgacctgtgcagaccacacaggaggaagatgggtgctcctgtcggttccccgaggaagaggaaggaggctgtgagctgcgggtcaagttttccagatctgcagacgcccctgcttaccagcagggccagaaccagctgtataacgagctgaatctggggcggagagaggaatacgacgtgctggataaaaggcgcgggagagacccagaaatggggggaaagccacgacggaaaaacccccaggagggactgtacaatgaactgcagaaggataaaatggcagaggcctattccgaaatcgggatgaagggagaaagaaggcgaggcaaaggacacgacggactgtaccaggggctgtctaccgccacaaaggacacctatgatgctctgcatatgcaggcactgccacccagg

SEQ ID NO: 608 - DNA, 1467 bp, Artificial Sequence
  Description of Artificial Sequence: Synthetic polynucleotide
atggcactgccagtgacagccctgctgctgcctctggccctgctgctgcacgccgccaggcctcaggtgcagctgcaggagtccggccctggcctggtgaagccatccgagaccctgtctctgacatgcaccgtgtccggcgattctatcaacaattacttttggagctggatcagacagccccctggcaagggactggagtggatcggctacttctatcacaggggcggcaacaattataacccaagcctgaagtcccgcgtgacaatcagcatcgacacctccaagaatcagttcagcctgaacctgaacagcgtgacaagcgccgataccgccgtgtactattgtgcccggctggccctggccggcttctttttcgactactggggccagggcacactggtgaccgtgagctccggaggaggaggctccggcggcggaggctctggcggcggcggctccggaggcggcggcagcgacatccagatgacacagtctccaagcaccctgtccgcctctgtgggcgatagggtgacaatcacctgcagagccagccagtccatctctagctggctggcctggtaccagcagaagccaggcaaggcccccaagctgctgatctataaggcctcctctctggagtctggcgtgccaagccggttttctggcagcggctccggcacagagttcacactgaccatcagctccctgcagcccgacgattttgccacctactattgtcagcagtacaactcttatagcagaacattcggccagggcaccaaggtggagatcaagaccacaacccctgcccctaggccacctaccccagcacctacaattgctagtcagccactgtcactgcgaccagaggcatgtcgacctgcagctggaggagcagtgcatacaaggggactggactttgcctgcgatatctacatttgggctcctctggcaggaacatgtggcgtgctgctgctgagcctggtcatcactctgtactgcaagcgaggccggaagaaactgctgtatattttcaaacagccctttatgcgacctgtgcagaccacacaggaggaagatgggtgctcctgtcggttccccgaggaagaggaaggaggctgtgagctgcgggtcaagttttccagatctgcagacgcccctgcttaccagcagggccagaaccagctgtataacgagctgaatctggggcggagagaggaatacgacgtgctggataaaaggcgcgggagagacccagaaatggggggaaagccacgacggaaaaacccccaggagggactgtacaatgaactgcagaaggataaaatggcagaggcctattccgaaatcgggatgaagggagaaagaaggcgaggcaaaggacacgacggactgtaccaggggctgtctaccgccacaaaggacacctatgatgctctgcatatgcaggcactgccacccagg

SEQ ID NO: 609 - DNA, 1491 bp, Artificial Sequence
  Description of Artificial Sequence: Synthetic polynucleotide
atggcactgccagtgacagccctgctgctgccactggccctgctgctgcacgccgcccggccacaggtgcccctggtgcagtccggagcagaggtgaagaagcccggcagctccgtgaaggtgtcttgcaaggccagcggcggcacattcagcacctacagcatctcctgggtgcggcaggcccctggccagggactggagtggatgggaggaatcatcccaatcttcggcaccacaaactacgcccagaagtttcagggcagagtgacaatcaccgccgacaagtctacaagcaccgcctatatggagctgtctagcctgaggtctgaggacaccgccgtgtactattgtgcccgcgatggcgagggcagctactattactattacggaatggacgtgtggggacagggaaccacagtgacagtgtcctctggaggaggaggcagcggcggaggaggctccggaggcggcggctctggcggcggcggctcccagtctgtgctgacccagccacctagcgcctccggaacacccggccagagggtgaccatctcttgcagcggcagctcctctaacatcggctccaattacgtgtactggtatcagcagctgcctggcacagccccaaagctgctgatctacagcaacaatcagcggccctccggcgtgcctgacagattctccggctctaagagcggcacctccgcctctctggcaatctccggactgcgctctgaggacgaggcagattattactgtgcagcatgggacgatagcctgtccggatgggtgtttggaggaggaacaaagctgaccgtgctgaccacaacccctgcccctaggccacctaccccagcacctacaattgctagtcagccactgtcactgcgaccagaggcatgtcgacctgcagctggaggagcagtgcatacaaggggactggactttgcctgcgatatctacatttgggctcctctggcaggaacatgtggcgtgctgctgctgagcctggtcatcactctgtactgcaagcgaggccggaagaaactgctgtatattttcaaacagccctttatgcgacctgtgcagaccacacaggaggaagatgggtgctcctgtcggttccccgaggaagaggaaggaggctgtgagctgcgggtcaagttttccagatctgcagacgcccctgcttaccagcagggccagaaccagctgtataacgagctgaatctggggcggagagaggaatacgacgtgctggataaaaggcgcgggagagacccagaaatggggggaaagccacgacggaaaaacccccaggagggactgtacaatgaactgcagaaggataaaatggcagaggcctattccgaaatcgggatgaagggagaaagaaggcgaggcaaaggacacgacggactgtaccaggggctgtctaccgccacaaaggacacctatgatgctctgcatatgcaggcactgccacccagg

SEQ ID NO: 610 - DNA, 1482 bp, Artificial Sequence
  Description of Artificial Sequence: Synthetic polynucleotide
atggcactgccagtgacagccctgctgctgccactggccctgctgctgcacgccgccagacccgaggtgcagctggtggagtccggaggaggactggtgcagcctggcggctccctgaggctgtcttgcgcagcaagcggcttcacctttagctcctacagcatgaactgggtgagacaggcccccggcaagggactggagtgggtgtcttatatctctagctcctctagcacaatctactatgccgacagcgtgaagggccggttcaccatctctagagataacgccaagaatagcctgtacctgcagatgaacagcctgagggacgaggatacagccgtgtactattgtgcccgcgacaaggagcggagatactattactatggcatggacgtgtggggccagggcaccacagtgaccgtgtcctctggcggcggcggctccggaggcggcggctctggaggaggaggcagcggcggaggaggctccgagatcgtgctgacacagtcccctgacaccctgtctctgagcccaggcgagagggccacactgtcttgcagggcatcccagtctgtgagcaggcgctacctggcctggtatcagcagaagcctggccaggcccccagactgctgatctacggagcaagcagccgggccacaggcatccctgacagattctccggctctggcagcggaaccgacttcaccctgaccatctccaggctggagccagaggattttgccgtgtactattgtcagcagttcggcacaagcccaatcacctttggccagggaacccgcctggagatcaagaccacaaccccagcccctaggccacctaccccagcacctacaattgctagtcagccactgtcactgcgaccagaggcatgtcgacctgcagctggaggagcagtgcatacaaggggactggactttgcctgcgatatctacatttgggctcctctggcaggaacatgtggcgtgctgctgctgagcctggtcatcactctgtactgcaagcgaggccggaagaaactgctgtatattttcaaacagccctttatgcgacctgtgcagaccacacaggaggaagatgggtgctcctgtcggttccccgaggaagaggaaggaggctgtgagctgcgggtcaagttttccagatctgcagacgcccctgcttaccagcagggccagaaccagctgtataacgagctgaatctggggcggagagaggaatacgacgtgctggataaaaggcgcgggagagacccagaaatggggggaaagccacgacggaaaaacccccaggagggactgtacaatgaactgcagaaggataaaatggcagaggcctattccgaaatcgggatgaagggagaaagaaggcgaggcaaaggacacgacggactgtaccaggggctgtctaccgccacaaaggacacctatgatgctctgcatatgcaggcactgccacccagg

SEQ ID NO: 611 - DNA, 1494 bp, Artificial Sequence
  Description of Artificial Sequence: Synthetic polynucleotide
atggcactgccagtgacagccctgctgctgccactggccctgctgctgcacgccgccagaccccaggtgcagctgcagcagagcggccctggcctggtgaagcctagccagaccctgtccctggcctgtgccatctctggcgacagcgtgagctccaactccgccatctggaattggatcaggcagtccccttctcgcggcctggagtggctgggaggaacatactatcggtctatgtggtacaacgactatgccgtgtccgtgaagtctagaatcacaatcaaccctgatacctccaagaatcagctgtctctgcagctgaatagcgtgacaccagaggataccgccgtgtactattgcagccggggcggaatcgtgggagtgccagacgccttcgatatctggggccagggcacaatggtgaccgtgtctagcggaggaggaggctccggaggaggaggctctggcggcggcggcagcggaggcggcggcagccagtccgtgctgacccagccaccttctgccagcggaacacccggccagcgggtgaccatctcctgttctggctcctctagcaacatcggcagcaacacagccaattggtaccagcagctgccaggcaccgcacccaggctgctgatctatcggaacaatcagagaccttccggagtgccagaccgcttcagcggctccaagtctggcacaagcgcctccctggccatctctggcctgcagagcgaggacgaggccgattactattgcgccgcctgggacgatagcctgaatggctacgtgtttggcacaggcaccaaggtgaccgtgctgaccacaacccctgcccctaggccacctaccccagcacctacaattgctagtcagccactgtcactgcgaccagaggcatgtcgacctgcagctggaggagcagtgcatacaaggggactggactttgcctgcgatatctacatttgggctcctctggcaggaacatgtggcgtgctgctgctgagcctggtcatcactctgtactgcaagcgaggccggaagaaactgctgtatattttcaaacagccctttatgcgacctgtgcagaccacacaggaggaagatgggtgctcctgtcggttccccgaggaagaggaaggaggctgtgagctgcgggtcaagttttccagatctgcagacgcccctgcttaccagcagggccagaaccagctgtataacgagctgaatctggggcggagagaggaatacgacgtgctggataaaaggcgcgggagagacccagaaatggggggaaagccacgacggaaaaacccccaggagggactgtacaatgaactgcagaaggataaaatggcagaggcctattccgaaatcgggatgaagggagaaagaaggcgaggcaaaggacacgacggactgtaccaggggctgtctaccgccacaaaggacacctatgatgctctgcatatgcaggcactgccacccagg

SEQ ID NO: 612 - DNA, 1476 bp, Artificial Sequence
  Description of Artificial Sequence: Synthetic polynucleotide
atggcactgcctgtgacagccctgctgctgccactggccctgctgctgcacgccgcccggccacaggtgcagctgcaggagtccggcccaggcctggtgaagccatctgagacactgagcctgacctgcaacgtgtctgatggcagcatcagctcctactattggacctggatcagacagccccctggcaagggactggactggatcggctatatcttctacagcggcaccacaaactataatccctccctgaagtctagagtgacaatctccctggacacctctaagaatcagttttctctgaagctgacaagcatgaccgccgccgatacagccgtgtactattgcgccaggatcagcgagaagtccttctattttgactactggggccagggcacactggtgaccgtgtctagcggaggaggaggctccggaggaggaggctctggcggcggcggcagcggaggcggcggctcccagtctgtgctgacccagccaccaagcgcctccggaacacctggccagcgcgtgaccatctcttgtagcggctcctctagcaacatcggctccaattacgtgtattggtaccagcagctgcctggcacagccccaaagctgctgatctactccaacaatcagcggcccagcggcgtgcctgatagattctccggctctaagagcggcacctccgcctctctggcaatcagcggactgaggtccgaggacgaggcagattactattgtgcaccatgggacgatagcctgtccggccgcgtgtttggaggaggaacaaagctgaccgtgctgaccacaacccctgcccctaggccacctaccccagcacctacaattgctagtcagccactgtcactgcgaccagaggcatgtcgacctgcagctggaggagcagtgcatacaaggggactggactttgcctgcgatatctacatttgggctcctctggcaggaacatgtggcgtgctgctgctgagcctggtcatcactctgtactgcaagcgaggccggaagaaactgctgtatattttcaaacagccctttatgcgacctgtgcagaccacacaggaggaagatgggtgctcctgtcggttccccgaggaagaggaaggaggctgtgagctgcgggtcaagttttccagatctgcagacgcccctgcttaccagcagggccagaaccagctgtataacgagctgaatctggggcggagagaggaatacgacgtgctggataaaaggcgcgggagagacccagaaatggggggaaagccacgacggaaaaacccccaggagggactgtacaatgaactgcagaaggataaaatggcagaggcctattccgaaatcgggatgaagggagaaagaaggcgaggcaaaggacacgacggactgtaccaggggctgtctaccgccacaaaggacacctatgatgctctgcatatgcaggcactgccacccagg

SEQ ID NO: 613 - DNA, 1479 bp, Artificial Sequence
  Description of Artificial Sequence: Synthetic polynucleotide
atggccctgccagtgaccgccctgctgctgccactggccctgctgctgcacgccgccaggccccaggtgcagctggtgcagagcggagcagaggtgaagcgccctggcgcaagcgtgaaggtgtcctgcaaggcctctggctatacattcaccagctactatatccactgggtgaggcaggcccctggccagggactggagtggatgggcgtgatcgtgccatccggcggctctatcagctatgcccagaagtttcagggcagggtgacaatgacccgcgacacaagcaccaacatcgtgtacatggagctgagctccctgcggtccgaggatacagccgtgtactattgtgccagagacagatactatggcgattactattacggactggacgtgtggggacagggaaccacagtgaccgtgtctagcggcggcggcggctctggaggaggaggcagcggcggaggaggctccggcggcggcggctctgacatccagatgacacagtccccttcctctctgtccgcctctgtgggcgatcgggtgacaatcacctgcagagcctctcagggcatcaacaatttcctggcctggtttcagcagaagcccggcaaggcccctaagtccctgatctacgcagcaagctccctgcagagcggagtgccatccaagttcagcggctccggctctggcacagactttacactgaccatccggtctctgcagccagaggatttcgccacctattactgtcagcactataatagctaccccatcacatttggccagggcaccagactggagatcaagaccacaacccccgcccctaggccacctaccccagcacctacaattgctagtcagccactgtcactgcgaccagaggcatgtcgacctgcagctggaggagcagtgcatacaaggggactggactttgcctgcgatatctacatttgggctcctctggcaggaacatgtggcgtgctgctgctgagcctggtcatcactctgtactgcaagcgaggccggaagaaactgctgtatattttcaaacagccctttatgcgacctgtgcagaccacacaggaggaagatgggtgctcctgtcggttccccgaggaagaggaaggaggctgtgagctgcgggtcaagttttccagatctgcagacgcccctgcttaccagcagggccagaaccagctgtataacgagctgaatctggggcggagagaggaatacgacgtgctggataaaaggcgcgggagagacccagaaatggggggaaagccacgacggaaaaacccccaggagggactgtacaatgaactgcagaaggataaaatggcagaggcctattccgaaatcgggatgaagggagaaagaaggcgaggcaaaggacacgacggactgtaccaggggctgtctaccgccacaaaggacacctatgatgctctgcatatgcaggcactgccacccagg

SEQ ID NO: 614 - DNA, 1470 bp, Artificial Sequence
  Description of Artificial Sequence: Synthetic polynucleotide
atggcactgccagtgacagccctgctgctgcctctggccctgctgctgcacgccgcccggccacaggtgcacctgcaggagtctggccctggcctggtgaagccatctgagacactgagcctgacatgtaccgtgagcggcggcagcatctcccactactattggacctggatcaggcagccccctggcaagggactggagtggatcggctacatctactattccggcatcaccaacttctctcctagcctgaagtctcgcgtgtccatctctgtggacagctccaagaatcagttcagcctgaacctgaacagcgtgacagccgccgataccgccgtgtactattgcgccggcatctccctggccggcttctactttgactattgggtgcagggcacactggtgaccgtgtctagcggaggaggaggcagcggaggaggaggctccggaggcggcggctctggcggcggcggcagcgagatcgtgctgacacagagcccaggcaccctgagcctgtcccccggcgagcgggccaccctgtcctgtagagcctctcagagcgtgtcccggtcttacctggcctggtatcagcagaagccaggccaggcccccagactgctgatctatggagcatcctctagggccacaggagtgccagaccgcttcagcggctccggctctggaaccgacttcaccctgaccatcagccggctggagcctgaggatttcgccgtgttttactgccagcagtatagcatctccccactgacattcggcggcggcaccaaggtggagatcaagaccacaacccctgcccctaggccacctaccccagcacctacaattgctagtcagccactgtcactgcgaccagaggcatgtcgacctgcagctggaggagcagtgcatacaaggggactggactttgcctgcgatatctacatttgggctcctctggcaggaacatgtggcgtgctgctgctgagcctggtcatcactctgtactgcaagcgaggccggaagaaactgctgtatattttcaaacagccctttatgcgacctgtgcagaccacacaggaggaagatgggtgctcctgtcggttccccgaggaagaggaaggaggctgtgagctgcgggtcaagttttccagatctgcagacgcccctgcttaccagcagggccagaaccagctgtataacgagctgaatctggggcggagagaggaatacgacgtgctggataaaaggcgcgggagagacccagaaatggggggaaagccacgacggaaaaacccccaggagggactgtacaatgaactgcagaaggataaaatggcagaggcctattccgaaatcgggatgaagggagaaagaaggcgaggcaaaggacacgacggactgtaccaggggctgtctaccgccacaaaggacacctatgatgctctgcatatgcaggcactgccacccagg

SEQ ID NO: 615 - DNA, 1479 bp, Artificial Sequence
  Description of Artificial Sequence: Synthetic polynucleotide
atggcactgcctgtgacagccctgctgctgccactggccctgctgctgcacgccgcccggccccaggtgcagctgcaggagtccggcccaggcctggtgaagccaagcgagaccctgtccctgacatgcaccgtgtccggcgtgtctatcagctcctactattggagctggatcaggcagccccctggcaagggactggagtggatcgcctacatctactattccggcaacaccaattattctcctagcctgaagtctcgcgtgacaatctctgtggacaccagcaaggatcagctgtctctgaagctgtctagcgtgacagccgccgacaccgccgtgtactattgcacaaggggcggcagcggaaccatcgacgtgttcgatatctggggacagggaaccatggtggccgtgtcctctggcggcggcggctccggaggcggcggctctggaggaggaggcagcggcggaggaggctcccagtctgtgctgacacagccaccaagcgtgtccgccgccccaggccagaaggtgaccatctcttgtagcggcagctcctctaacatcggcaacaattacgtgtcctggtatcagcagctgcctggcacagccccaaagctgctgatctacgacaacaataagcggcccagcggcatccctgatagattctccggctctaagagcggcacatccgccaccctgggcatcacaggactgcagaccggcgacgaggcagattactattgtgagacctgggatagctccctgagcgccgtggtgtttggaggaggcacaaagctgaccgtgctgaccacaacccctgcccctaggccacctaccccagcacctacaattgctagtcagccactgtcactgcgaccagaggcatgtcgacctgcagctggaggagcagtgcatacaaggggactggactttgcctgcgatatctacatttgggctcctctggcaggaacatgtggcgtgctgctgctgagcctggtcatcactctgtactgcaagcgaggccggaagaaactgctgtatattttcaaacagccctttatgcgacctgtgcagaccacacaggaggaagatgggtgctcctgtcggttccccgaggaagaggaaggaggctgtgagctgcgggtcaagttttccagatctgcagacgcccctgcttaccagcagggccagaaccagctgtataacgagctgaatctggggcggagagaggaatacgacgtgctggataaaaggcgcgggagagacccagaaatggggggaaagccacgacggaaaaacccccaggagggactgtacaatgaactgcagaaggataaaatggcagaggcctattccgaaatcgggatgaagggagaaagaaggcgaggcaaaggacacgacggactgtaccaggggctgtctaccgccacaaaggacacctatgatgctctgcatatgcaggcactgccacccagg

SEQ ID NO: 616 - DNA, 1485 bp, Artificial Sequence
  Description of Artificial Sequence: Synthetic polynucleotide
atggcactgcctgtgacagccctgctgctgccactggccctgctgctgcacgccgcccggcctcaggtgcagctgcagcagagcggcccaggcctggtgaagccatcccagacactgtctctgacctgcgccatctccggcgacaacgtgtccacaaattctgccgcctggaactggatcaggcagagcccatcccgcggcctggagtggctgggctggacctactataggagcaagtggtacaatgactatgccgtgagcctgaagtcccgcatcaacatcaatccagatacctccaagaaccagttctctctgcagctgaatagcgtgacacccgaggataccgccgtgtactattgcgcccggtgggtgaacagagacgtgtttgatatctggggccagggcacaatggtgaccgtgagctccggaggaggaggctccggcggcggaggctctggcggcggcggcagcggaggcggcggctctcagagcgccctgacacagccagcatccgtgtctggcagccctggccagagcatcaccatctcctgtacaggcacctctagcgacgtgggctcctacaatctggtgtcttggtatcagcagcaccccggcaaggcccctaagctgatgatctacgagggcagcaagaggccatctggcgtgagcaacagattctccggctctaagagcggcaatacagcctctctgaccatcagcggactgcaggcagaggacgaggcagattactattgctgttcctatgccggctcctctacctgggtgtttggcggcggcacaaagctgaccgtgctgaccacaacccctgcccctaggccacctaccccagcacctacaattgctagtcagccactgtcactgcgaccagaggcatgtcgacctgcagctggaggagcagtgcatacaaggggactggactttgcctgcgatatctacatttgggctcctctggcaggaacatgtggcgtgctgctgctgagcctggtcatcactctgtactgcaagcgaggccggaagaaactgctgtatattttcaaacagccctttatgcgacctgtgcagaccacacaggaggaagatgggtgctcctgtcggttccccgaggaagaggaaggaggctgtgagctgcgggtcaagttttccagatctgcagacgcccctgcttaccagcagggccagaaccagctgtataacgagctgaatctggggcggagagaggaatacgacgtgctggataaaaggcgcgggagagacccagaaatggggggaaagccacgacggaaaaacccccaggagggactgtacaatgaactgcagaaggataaaatggcagaggcctattccgaaatcgggatgaagggagaaagaaggcgaggcaaaggacacgacggactgtaccaggggctgtctaccgccacaaaggacacctatgatgctctgcatatgcaggcactgccacccagg

SEQ ID NO: 617 - DNA, 1488 bp, Artificial Sequence
  Description of Artificial Sequence: Synthetic polynucleotide
atggccctgccagtgaccgccctgctgctgcccctggccctgctgctgcacgccgccaggccccaggtgcagctggtggagtccggaggaggagtggtgcagcctggccggtctctgagactgagctgcgcagcatccggcttcaccttcagctcctacggaatgcactgggtgcggcagacccctggcaagggactggagtgggtggccgtgatctcctatgacggcaactctaattactatgccgatagcgtgaagggcaggttcacaatctctcgcgacaacagcaagaataccctgtacctgcagatgaactctctgcgggccgaggacacagccgtgtactattgtgccagagatggcgccacagtgaccagctactattactatggcatggacgtgtggggccagggcaccacagtgaccgtgtctagcggaggaggaggcagcggaggaggaggctccggaggcggcggctctggcggcggcggcagcgagatcgtgctgacacagtcccctggcaccctgagcctgtccccaggcgagcgggccacactgtcttgcagagcctctcagagcgtgtccaggacctacctggcctggtatcaccagaagcctggccaggcacctcgcctgctgatctacggagcatcctctagggccacaggcatcagcgaccgcttctctggcagcggctccggaaccgacttcaccctgaccatctcccggctggagccagaggacttcgccgtgtactattgtcagcagtatggcacatcccccatcacctttggccagggcaccagactggagatcaagaccacaacccccgcccctaggccacctaccccagcacctacaattgctagtcagccactgtcactgcgaccagaggcatgtcgacctgcagctggaggagcagtgcatacaaggggactggactttgcctgcgatatctacatttgggctcctctggcaggaacatgtggcgtgctgctgctgagcctggtcatcactctgtactgcaagcgaggccggaagaaactgctgtatattttcaaacagccctttatgcgacctgtgcagaccacacaggaggaagatgggtgctcctgtcggttccccgaggaagaggaaggaggctgtgagctgcgggtcaagttttccagatctgcagacgcccctgcttaccagcagggccagaaccagctgtataacgagctgaatctggggcggagagaggaatacgacgtgctggataaaaggcgcgggagagacccagaaatggggggaaagccacgacggaaaaacccccaggagggactgtacaatgaactgcagaaggataaaatggcagaggcctattccgaaatcgggatgaagggagaaagaaggcgaggcaaaggacacgacggactgtaccaggggctgtctaccgccacaaaggacacctatgatgctctgcatatgcaggcactgccacccagg

SEQ ID NO: 618 - DNA, 1503 bp, Artificial Sequence
  Description of Artificial Sequence: Synthetic polynucleotide
atggcactgcctgtgacagccctgctgctgccactggccctgctgctgcacgccgccaggccccaggtgcagctgcagcagagcggcccaggcctggtgaagccatctcagacactgagcctgacctgcgccatctctggcgacagcgtgagctccaactccgccgtgtggaattggatcaggcagagcccttcccgcggcctggagtggctgggacggacctactatagatctaagtggtacaacgactatgccgtgtccgtgaagtctaggatcacaatcaaccccgatacctcccgcaatcagttctctctgcagctgaatagcgtgacacctgaggataccgccgtgtactattgcgccagaggcggaatcgtgggcgccccagacggctttgatatctggggccagggcacaatggtgaccgtgtctagcggaggaggaggctccggaggaggaggctctggcggcggcggcagcggaggcggcggctccgacatcgtgatgacacagagccctgattccctggccgtgtctctgggcgagagggcaaccatcaactgtaagtcctctcagagcgtgctggacagctccaacaataacaattacttcgcctggtatcagcagagacctggccagccccctcacctgctgatctactgggcatctagccgggagagcggagtgccagacagattctctggcagcggctccggcacagacttcaccctgaccatctcctctctgcaggccgaggatgtggccgtgtactattgtcagcagtactattccacaccatatacctttggccagggcaccaagctggagatcaagaccacaacccccgcccctaggccacctaccccagcacctacaattgctagtcagccactgtcactgcgaccagaggcatgtcgacctgcagctggaggagcagtgcatacaaggggactggactttgcctgcgatatctacatttgggctcctctggcaggaacatgtggcgtgctgctgctgagcctggtcatcactctgtactgcaagcgaggccggaagaaactgctgtatattttcaaacagccctttatgcgacctgtgcagaccacacaggaggaagatgggtgctcctgtcggttccccgaggaagaggaaggaggctgtgagctgcgggtcaagttttccagatctgcagacgcccctgcttaccagcagggccagaaccagctgtataacgagctgaatctggggcggagagaggaatacgacgtgctggataaaaggcgcgggagagacccagaaatggggggaaagccacgacggaaaaacccccaggagggactgtacaatgaactgcagaaggataaaatggcagaggcctattccgaaatcgggatgaagggagaaagaaggcgaggcaaaggacacgacggactgtaccaggggctgtctaccgccacaaaggacacctatgatgctctgcatatgcaggcactgccacccagg

SEQ ID NO: 619 - DNA, 1485 bp, Artificial Sequence
  Description of Artificial Sequence: Synthetic polynucleotide
atggccctgccagtgaccgccctgctgctgccactggccctgctgctgcacgccgcccggccacaggtgcagctgcagcagagcggccctggcctggtgaagcctagccagacactgtccctgacctgcgccatctctggcgacagcgtgagctccaacaccacagcctggaagtggagcagacagtccccctctaagggcctggagtggctgggctggacatactataggtccaagtggtactatgactacaccgtgtccgtgaagtctcgcatcacaatcaaccccgatacctccaagaatcagttctctctgcagctgaatagcgtgacacctgaggataccgccgtgtactattgcgccaggtggatcttccacgacgcctttgatatctggggccagggcacaatggtgaccgtgtctagcggaggaggaggctccggaggaggaggctctggcggcggcggcagcggaggcggcggcagccagtccgccctgacacagccaccttctgccagcggaacacctggccagagagtgaccatctcctgttctggctcctctagcaacatcggcagcaacaccgtgaattggtaccagcagctgccaggcacagcccccaagctgctgatctataccaacaatcagaggccttccggagtgccagaccggttcagcggctccaagtctggcacaagcgcctccctggccatctctggcctgcagagcgaggacgaggccgattatttctgttccacctgggacgattctctgaatggacccgtgttcggaggaggaacaaagctgaccgtgctgaccacaaccccagcccctaggccacctaccccagcacctacaattgctagtcagccactgtcactgcgaccagaggcatgtcgacctgcagctggaggagcagtgcatacaaggggactggactttgcctgcgatatctacatttgggctcctctggcaggaacatgtggcgtgctgctgctgagcctggtcatcactctgtactgcaagcgaggccggaagaaactgctgtatattttcaaacagccctttatgcgacctgtgcagaccacacaggaggaagatgggtgctcctgtcggttccccgaggaagaggaaggaggctgtgagctgcgggtcaagttttccagatctgcagacgcccctgcttaccagcagggccagaaccagctgtataacgagctgaatctggggcggagagaggaatacgacgtgctggataaaaggcgcgggagagacccagaaatggggggaaagccacgacggaaaaacccccaggagggactgtacaatgaactgcagaaggataaaatggcagaggcctattccgaaatcgggatgaagggagaaagaaggcgaggcaaaggacacgacggactgtaccaggggctgtctaccgccacaaaggacacctatgatgctctgcatatgcaggcactgccacccagg

SEQ ID NO: 620 - DNA, 1458 bp, Artificial Sequence
  Description of Artificial Sequence: Synthetic polynucleotide
atggcactgcctgtgacagccctgctgctgccactggccctgctgctgcacgccgccagaccccaggtgcagctgcaggagtccggcccaggcctggtgaagccaagcgagaccctgtccctgacatgcaccgtgtctggcgacagcatcagctccctgtcttggagctggatcaggcagacaccaggcgagggcctggagtggatcggctacctgtactattccggctctaccgactataacccctccctgaagtctcgcgtgacaatctctgtggataccagcaagaatcagttctctctgaagctgcggagcgtggctgccgccgacacagccctgtactattgcgccagaggccggagagcctttgatatctggggccagggcacaatggtgaccgtgtctagcggaggaggaggctccggaggaggaggctctggcggcggcggcagcggaggcggcggctccgacatccagatgacccagagcccttcctctctgagcgcctccgtgggcgatagggtgacaatcacctgtcgcggctcccagggcatctctaactacctggcatggttccagcagcggcccggcaaggcacctaagtctctgatctatgcagcaagctccctggagagcggagtgccatccaagttctctggcagcggctccggcacagactttacactgaccatcatcagcctgcagcccgaggatttcgccacctactattgtcagcagtactataattaccctatcacatttggccagggcacccggctggagatcaagaccacaacccctgcccctaggccacctaccccagcacctacaattgctagtcagccactgtcactgcgaccagaggcatgtcgacctgcagctggaggagcagtgcatacaaggggactggactttgcctgcgatatctacatttgggctcctctggcaggaacatgtggcgtgctgctgctgagcctggtcatcactctgtactgcaagcgaggccggaagaaactgctgtatattttcaaacagccctttatgcgacctgtgcagaccacacaggaggaagatgggtgctcctgtcggttccccgaggaagaggaaggaggctgtgagctgcgggtcaagttttccagatctgcagacgcccctgcttaccagcagggccagaaccagctgtataacgagctgaatctggggcggagagaggaatacgacgtgctggataaaaggcgcgggagagacccagaaatggggggaaagccacgacggaaaaacccccaggagggactgtacaatgaactgcagaaggataaaatggcagaggcctattccgaaatcgggatgaagggagaaagaaggcgaggcaaaggacacgacggactgtaccaggggctgtctaccgccacaaaggacacctatgatgctctgcatatgcaggcactgccacccagg

SEQ ID NO: 621 - DNA, 1488 bp, Artificial Sequence
  Description of Artificial Sequence: Synthetic polynucleotide
atggcactgcctgtgaccgccctgctgctgccactggccctgctgctgcacgccgcccggccacaggtgcagctggtgcagtctggagcagaggtgaagaagcctggcgcaagcgtgaaggtgtcctgcaaggcctctggctacacattcaccggctactatatgcactgggtgagacaggcccctggccagggactggagtggatgggctggatcaaccctaatagcggcggcaccaactacgcccagaagtttcagggccgggtgacaatgaccagagacaccagcgtgtccacagcctatatggagctgagcaggctgacctccgacgatacagccatctactattgtgccaaggacggcggcggcgatttctacttttatggcatggacgtgtggggccagggcaccacagtgaccgtgagctccggcggcggcggctctggaggaggaggcagcggcggaggaggctccggaggaggcggctctcagaccgtggtgacacaggagccatctttcagcgtgtcccccggcggaacagtgaccctgacatgcggcctgtctagcggctctgtgagcacatcctactatcctagctgtttccagcagacccccggccaggcacctagaacactgatctactccaccgacacaaggtcctctggcgtgccagatcgcttttctggcagcatcctgggcaataaggccgccctgaccatcacaggagcacaggccgacgatgagtccgactactattgcgtgctgtatatgggctccggaatcagcgtgttcggaggaggcaccaagctgacagtgctgaccacaacccccgcccctaggccacctaccccagcacctacaattgctagtcagccactgtcactgcgaccagaggcatgtcgacctgcagctggaggagcagtgcatacaaggggactggactttgcctgcgatatctacatttgggctcctctggcaggaacatgtggcgtgctgctgctgagcctggtcatcactctgtactgcaagcgaggccggaagaaactgctgtatattttcaaacagccctttatgcgacctgtgcagaccacacaggaggaagatgggtgctcctgtcggttccccgaggaagaggaaggaggctgtgagctgcgggtcaagttttccagatctgcagacgcccctgcttaccagcagggccagaaccagctgtataacgagctgaatctggggcggagagaggaatacgacgtgctggataaaaggcgcgggagagacccagaaatggggggaaagccacgacggaaaaacccccaggagggactgtacaatgaactgcagaaggataaaatggcagaggcctattccgaaatcgggatgaagggagaaagaaggcgaggcaaaggacacgacggactgtaccaggggctgtctaccgccacaaaggacacctatgatgctctgcatatgcaggcactgccacccagg

SEQ ID NO: 622 - protein, 569 aa, Artificial Sequence
  Description of Artificial Sequence: Synthetic polypeptide
MALPVTALLLPLALLLHAARPGGGGSCPYSNPSLCSGGGGSGGGGSQLQLQESGPGLVKPSETLSLTCTVSGGSISSSSYYWGWIRQPPGKGLEWIGSIYYSGNIYHNPSLKSRVSISVDTSKNQFSLRLSSVTAADTAVYYCAREIIVGATHFDYWGQGTLVTVSSGGGGSGGGGSGGGGSGGGGSAIQMTQSPSSLSASVGDRVTITCRASQGIRNDLGWYQQKPGKAPELLIYAASSLQSGVPSRFSGSGSGTDFTLTISSLQPEDFATYYCLQDYNYPLTFGPGTKVDIKGSGGGGSCPYSNPSLCSGGGGSELPTQGTFSNVSTNVSPAKPTTTACPYSNPSLCTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 623 - protein, 539 aa, Artificial Sequence
  Description of Artificial Sequence: Synthetic polypeptide
MALPVTALLLPLALLLHAARPQLQLQESGPGLVKPSETLSLTCTVSGGSISSSSYYWGWIRQPPGKGLEWIGSIYYSGNIYHNPSLKSRVSISVDTSKNQFSLRLSSVTAADTAVYYCAREIIVGATHFDYWGQGTLVTVSSGGGGSGGGGSGGGGSGGGGSAIQMTQSPSSLSASVGDRVTITCRASQGIRNDLGWYQQKPGKAPELLIYAASSLQSGVPSRFSGSGSGTDFTLTISSLQPEDFATYYCLQDYNYPLTFGPGTKVDIKGSGGGGSCPYSNPSLCSGGGGSCPYSNPSLCSGGGGSTTTACPYSNPSLCTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 624 - protein, 527 aa, Artificial Sequence
  Description of Artificial Sequence: Synthetic polypeptide
MALPVTALLLPLALLLHAARPGGGGSCPYSNPSLCGGGGSQLQLQESGPGLVKPSETLSLTCTVSGGSISSSSYYWGWIRQPPGKGLEWIGSIYYSGNIYHNPSLKSRVSISVDTSKNQFSLRLSSVTAADTAVYYCAREIIVGATHFDYWGQGTLVTVSSGGGGSGGGGSGGGGSGGGGSAIQMTQSPSSLSASVGDRVTITCRASQGIRNDLGWYQQKPGKAPELLIYAASSLQSGVPSRFSGSGSGTDFTLTISSLQPEDFATYYCLQDYNYPLTFGPGTKVDIKGGGGSCPYSNPSLCGGGGSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 625 - protein, 522 aa, Artificial Sequence
  Description of Artificial Sequence: Synthetic polypeptide
MALPVTALLLPLALLLHAARPGGGGSCPYSNPSLCGGGGSCPYSNPSLCGGGGSQLQLQESGPGLVKPSETLSLTCTVSGGSISSSSYYWGWIRQPPGKGLEWIGSIYYSGNIYHNPSLKSRVSISVDTSKNQFSLRLSSVTAADTAVYYCAREIIVGATHFDYWGQGTLVTVSSGGGGSGGGGSGGGGSGGGGSAIQMTQSPSSLSASVGDRVTITCRASQGIRNDLGWYQQKPGKAPELLIYAASSLQSGVPSRFSGSGSGTDFTLTISSLQPEDFATYYCLQDYNYPLTFGPGTKVDIKTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 626 - protein, 545 aa, Artificial Sequence
  Description of Artificial Sequence: Synthetic polypeptide
MALPVTALLLPLALLLHAARPQVQLQQSGPGLVKPSQTLSLTCAISGDSVSSNSATWNWIRQSPSRGLEWLGRTYYRSKWYDDYAVSVKSRITINPDTSKNHLSLHLNSVTPEDTAVYYCAGGGLVGAPDGFDVWGQGTMVTVSSGGGGSGGGGSGGGGSGGGGSQSVLTQPPSASGTPGQRVTISCSGSSSNIGSDPVNWYQQLPGTAPKLLIYSNNQRPSGVPDRFSGSKSGTSASLAISGLQSEDEADYYCSAWDDSLNGYVFGTGTKVTVLGSGGGGSCPYSNPSLCSGGGGSCPYSNPSLCSGGGGSTTTACPYSNPSLCTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 627 - protein, 533 aa, Artificial Sequence
  Description of Artificial Sequence: Synthetic polypeptide
MALPVTALLLPLALLLHAARPGGGGSCPYSNPSLCGGGGSQVQLQQSGPGLVKPSQTLSLTCAISGDSVSSNSATWNWIRQSPSRGLEWLGRTYYRSKWYDDYAVSVKSRITINPDTSKNHLSLHLNSVTPEDTAVYYCAGGGLVGAPDGFDVWGQGTMVTVSSGGGGSGGGGSGGGGSGGGGSQSVLTQPPSASGTPGQRVTISCSGSSSNIGSDPVNWYQQLPGTAPKLLIYSNNQRPSGVPDRFSGSKSGTSASLAISGLQSEDEADYYCSAWDDSLNGYVFGTGTKVTVLGGGGSCPYSNPSLCGGGGSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 628 - protein, 528 aa, Artificial Sequence
  Description of Artificial Sequence: Synthetic polypeptide
MALPVTALLLPLALLLHAARPGGGGSCPYSNPSLCGGGGSCPYSNPSLCGGGGSQVQLQQSGPGLVKPSQTLSLTCAISGDSVSSNSATWNWIRQSPSRGLEWLGRTYYRSKWYDDYAVSVKSRITINPDTSKNHLSLHLNSVTPEDTAVYYCAGGGLVGAPDGFDVWGQGTMVTVSSGGGGSGGGGSGGGGSGGGGSQSVLTQPPSASGTPGQRVTISCSGSSSNIGSDPVNWYQQLPGTAPKLLIYSNNQRPSGVPDRFSGSKSGTSASLAISGLQSEDEADYYCSAWDDSLNGYVFGTGTKVTVLTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 629 - protein, 249 aa, Artificial Sequence
  Description of Artificial Sequence: Synthetic polypeptide
EVQLLESGGGLVQPGGSLRLSCAASGFTFSSYAMNWVRQAPGKGLEWVSTISGSGGSTYYADSVKGRFTISRDNSKNTLYLQMNSLRAEDTAVFYCAIDPEYYDILTGGDYWGQGTLVTVSSGGGGSGGGGSGGGGSGGGGSDIQMTQSPSAMSASVGDRVTITCRASQGISNYLAWFQQKPGKVPKRLIYAASSLQSGVPSRFSGSGSGTEFTLTISSLQPEDFATYFCLQHDSFPLTFGGGTKVEIK

SEQ ID NO: 630 - DNA, 60 bp, Artificial Sequence
  Description of Artificial Sequence: Synthetic oligonucleotide
ggcggcggcggctctggaggaggaggcagcggcggaggaggctccggaggcggcggctct

SEQ ID NO: 631 - DNA, 1467 bp, Artificial Sequence
  Description of Artificial Sequence: Synthetic polynucleotide
atggctctgcccgtcaccgctctgctgctgcctctggctctgctgctgcacgccgcacgaccagaggtgcagctggtggagagcggaggaggcctggtgcagcctggcggcagcctgaggctgtcctgcgcagcatctggcttcacctttagctcccacgacatgcactgggtgaggcaggcaacaggcaagggcctggagtgggtgtccgccatcggaatcgcaggcgatacctactattccggctctgtgaagggccggttcacaatcagcagagagaacgccaagaattccctgtacctgcagatgaactctctgagggccggcgacaccgccgtgtactattgtgccagagccaattggggcgagggcgcctttgatatctggggccagggcaccatggtgacagtgtctagcggcggcggcggctctggaggaggaggcagcggcggaggaggctccggaggcggcggctctgacatccagatgacacagtctcctagctccctgtccgcctctgtgggcgaccgggtgaccatcacatgcagagccagccagggcatctccgattacctggcctggtatcagcagaagcccggcaagatccctaagctgctgatctacgcagcatctaccctgcagagcggagtgccatcccggttcagcggatccggatctggaacagactttaccctgacaatctctagcctgcagccagaggatgtggccacctactattgtcagaagtataactccgtgccactgaccttcggcggaggaacaaaggtggagatcaagaccacaactcctgcacctaggccacctaccccagcacctacaattgctagtcagccactgtcactgcgaccagaggcatgtcgacctgcagctggaggagcagtgcatacaaggggactggactttgcctgcgatatctacatttgggctcctctggcaggaacatgtggcgtgctgctgctgagcctggtcatcactctgtactgcaagcgaggccggaagaaactgctgtatattttcaaacagccctttatgcgacctgtgcagaccacacaggaggaagatgggtgctcctgtcggttccccgaggaagaggaaggaggctgtgagctgcgggtcaagttttccagatctgcagacgcccctgcttaccagcagggccagaaccagctgtataacgagctgaatctggggcggagagaggaatacgacgtgctggataaaaggcgcgggagagacccagaaatggggggaaagccacgacggaaaaacccccaggagggactgtacaatgaactgcagaaggataaaatggcagaggcctattccgaaatcgggatgaagggagaaagaaggcgaggcaaaggacacgacggactgtaccaggggctgtctaccgccacaaaggacacctatgatgctctgcatatgcaggcactgccacccagg

SEQ ID NO: 632 - protein, 489 aa, Artificial Sequence
  Description of Artificial Sequence: Synthetic polypeptide
MALPVTALLLPLALLLHAARPQVQLQESGPGLVKPSETLSLTCTVSDNSISNYYWSWIRQPPGKGLEWIAYIYYSGTTNYNPSLKSRVTISLDTSKNQFSLKLSSVTAADTAVYYCARLFNWGFAFDIWGQGTMVTVSSGGGGSGGGGSGGGGSGGGGSEIVMTQSPATLSVSPGERATLSCRASQSVSSNLAWYQQKPGQAPRLLIYGASTRATGIPARFSGSGSGTEFTLTISSLQSEDFAVYYCQQYNNWPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 633 - protein, 490 aa, Artificial Sequence
  Description of Artificial Sequence: Synthetic polypeptide
MALPVTALLLPLALLLHAARPQVQLQESGPGLMKPSETLSLTCTVSGGSISSSYWSCIRQPPGKGLEWIGYIYYSGTTNYNPSLKSRVTLSLDTSKNQFSLRLTSVTAADTAVYYCARVAPTGFWFDYWGQGTLVTVSSGGGGSGGGGSGGGGSGGGGSEIVLTQSPGTLSLSPGERATLSCRASQRVSSRYLAWYQQKPGQAPRLLIYGASSRATGIPDRFSGSGSGTDFTLTISRLEPEEFAVYYCQQYGTSPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 634 - protein, 489 aa, Artificial Sequence
  Description of Artificial Sequence: Synthetic polypeptide
MALPVTALLLPLALLLHAARPEVQLVESGGGLVQPGGSLRLSCAASGFTFSSHDMHWVRQATGKGLEWVSAIGIAGDTYYSGSVKGRFTISRENAKNSLYLQMNSLRAGDTAVYYCARANWGEGAFDIWGQGTMVTVSSGGGGSGGGGSGGGGSGGGGSDIQMTQSPSSLSASVGDRVTITCRASQGISDYLAWYQQKPGKIPKLLIYAASTLQSGVPSRFSGSGSGTDFTLTISSLQPEDVATYYCQKYNSVPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 635 - protein, 490 aa, Artificial Sequence
  Description of Artificial Sequence: Synthetic polypeptide
MALPVTALLLPLALLLHAARPQVQLQESGPGLVKPSETLSLTCTVSDDSISNYYWSWIRQPPGKGLEWIGYIFYSGTTNHNPSLKSRLTISLDKAKNQFSLRLSSVTAADTAVYYCARVFNWGFAFDIWGQGTMVTVSSGGGGSGGGGSGGGGSGGGGSEIVLTQSPGTLSLSPGERATLSCRASQRISRTYLAWYQQKPGQAPRLLIYGASSRATGIPDRFTGSGSGTDFTLTISRLEPEDFAVYYCQQYGTSPLTFGGGTKVEINTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 636 - protein, 490 aa, Artificial Sequence
  Description of Artificial Sequence: Synthetic polypeptide
MALPVTALLLPLALLLHAARPQVQLQESGPGLVKPSETLSLTCTVSDNSISNYYWSWIRQPPGKGLEWIAYIYYSGTTNYNPSLKSRVTISLDTSKNQFSLQLSSVTAADAAVYYCARVFHWGFAFDIWGQGTMVTVSSGGGGSGGGGSGGGGSGGGGSEIVLTQSPGTLSLSPGERATLSCRASQRVSNTYLAWYQQNPGQAPRLLIYGASSRATGIPDRFSGSGSGTDFTLTISRLEPEDFAVYYCQQYGTSPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 637 - protein, 490 aa, Artificial Sequence
  Description of Artificial Sequence: Synthetic polypeptide
MALPVTALLLPLALLLHAARPQVQLQESGPGLVKPSETLSLTCTVSNVSISSYYWSWIRQPPGKGLEWIGYIYYSGTTNYNPSLKSRVTMSVDTSKNQFSLKLSSVTAADTAVYFCARLSNWGFAFDIWGQGTMVTFSSGGGGSGGGGSGGGGSGGGGSEIVLTQSPGTLSLSPGERATLSCRASQTISSSYLAWYQQKPGQAPRLLIYGASSRATGIPDRFSGSGSGTEFTLTISRLEPEDFAVYYCQQYGWSPITFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 638 - protein, 496 aa, Artificial Sequence
  Description of Artificial Sequence: Synthetic polypeptide
MALPVTALLLPLALLLHAARPEVQLVESGGGLVQPGGSLRLSCAASGFTFSSYDMHWVRQATGKGLEWVSAIGPAGDTYYPGSVKGRFTISRENAKNSLYLQMNSLRAGDTAVYYCARADPPYYYYGMDVWGQGTTVTVSSGGGGSGGGGSGGGGSGGGGSDIVMTQSPLSLPVTPGEPASISCRSSQSLLHSNEYNYLDWYLQKPGQSPQLLIYLGSNRASGVPDRFSGSGSGTDFILKISRVEAEDVGVYYCMQALEIPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 639 - protein, 491 aa, Artificial Sequence
  Description of Artificial Sequence: Synthetic polypeptide
MALPVTALLLPLALLLHAARPQITLKESGPTLVKPTQTLTLTCTFSGFSLSTRGVGVGWIRQPPGKALEWLALIYWNDDKRYSPSLQTRLTITKDTPKNQVVLTMTNMDPVDTATYYCARSNWGNWYFALWGRGTLVTVSSGGGGSGGGGSGGGGSGGGGSEIVLTQSPATLSLSPGERATLSCRASQSVSSYLAWYQQKPGQAPRLLIYDAFYRATGIPARFSGSGSGTDFTLTISSLEPEDFAVYYCQHRSNWPITFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 640 - protein, 490 aa, Artificial Sequence
  Description of Artificial Sequence: Synthetic polypeptide
MALPVTALLLPLALLLHAARPQVQLQESGPGLVKPSETLSLTCTVSGDSISNYYWTWIRQPPGKGLEWIGYIYYSGTTNSNPSLKSRVTVSLDTSKSQFSLNLSSVTAADTAVYYCARVFNRGFAFDIWGQGTMVTVSSGGGGSGGGGSGGGGSGGGGSEIVLTQSPGTLSLSPGERATLSCRASQRISNTYLAWYQQKPGQAPRLLIYGASSRATGIPDRFSGSGSGTDFTLTISRLEPEDFAAYYCQQYDTSPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 641 - protein, 499 aa, Artificial Sequence
  Description of Artificial Sequence: Synthetic polypeptide
MALPVTALLLPLALLLHAARPQVTLRESGPALVKPTQTLTLTCTVSGVSLSTSGMCVSWIRQPLGKALEWLGFIDWDDDKYYNTSLKTRLTISKDTSKNQVVLTMTNMDPVDTATYYCARIRGYSGSYDAFDIWGQGTVVIVSSGGGGSGGGGSGGGGSGGGGSDIVMTQSPLSLPVTPGEPASISCRSSQSLLHSNGYNHLDWYLQKPGQSPQVLIYLGSNRASGVPDRFSGSGSGTDFTLKISRVEAEDVGVYFCMQALQTPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 642 - protein, 489 aa, Artificial Sequence
  Description of Artificial Sequence: Synthetic polypeptide
MALPVTALLLPLALLLHAARPQVQLQVSGPGLVKPSETLSLTCSVSGGSISSYYWSWIRQSPGKGLDWIGYMYYSGTTNYNPSLKSRVTISVDTSKNQFSLKLSSVTATDTAVYYCARVGLTGFFFDYWGQGTLVTVSSGGGGSGGGGSGGGGSGGGGSAIQMTQSPSSLSASVGDRVTITCRASQGIRNDLGWYQQKPGKAPKLLIYAASSLQSGVPSRFSGSGSGTDFTLTVSSLQPEDFATYYCLQDYNYPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 643 - protein, 486 aa, Artificial Sequence
  Description of Artificial Sequence: Synthetic polypeptide
MALPVTALLLPLALLLHAARPQVQLQQWGGGLLKPSETLSLTCAVYGGSSSGNYWSWIRQPPGKRLEWIGEINHSGTTSYNPSLKSRVTISVDTSKNQFSLKLSSVTAADTAVYYCARGELGIADSWGQGTLVTVSSGGGGSGGGGSGGGGSGGGGSDIQMTQSPSTLSASVGDRVTITCRASQSISRWLAWYQQKPGKAPKLLIYKASSLESGVPSRFSGSGSGTEFTLTISSLQPDDFATYYCQQYNSYSTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 644 - protein, 492 aa, Artificial Sequence
  Description of Artificial Sequence: Synthetic polypeptide
MALPVTALLLPLALLLHAARPQLQLQESGPGLVKPSETLSLTCTVSGGSISSSSYYWGWIRQPPGKGLEWIGSIYYSGNIYHNPSLKSRVSISVDTSKNQFSLRLSSVTAADTAVYYCAREIIVGATHFDYWGQGTLVTVSSGGGGSGGGGSGGGGSGGGGSAIQMTQSPSSLSASVGDRVTITCRASQGIRNDLGWYQQKPGKAPELLIYAASSLQSGVPSRFSGSGSGTDFTLTISSLQPEDFATYYCLQDYNYPLTFGPGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 645 - protein, 490 aa, Artificial Sequence
  Description of Artificial Sequence: Synthetic polypeptide
MALPVTALLLPLALLLHAARPQVQLQQWGAGLLKPSETLSLTCAVYGGSFSGYYWSWIRQPPGKGLEWIGEIIHSGSSNYNPSLKSRVSISVDTSKNQFSLKLSSVTAADTAVYYCSRGEYGSGSRFDYWGQGTLVTVSSGGGGSGGGGSGGGGSGGGGSAIQMTQSPSSLSASVGDRVAITCRASQGIRDDLGWYQQKPGKAPKLLIYAASSLQSGVPSRFSGSRSDTDFTLTISSLQPEDFATYYCLQDYDYPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 646 - protein, 487 aa, Artificial Sequence
  Description of Artificial Sequence: Synthetic polypeptide
MALPVTALLLPLALLLHAARPQVQLQESGPGLVKPSGTLSLTCAVSGGSISSNNWWSWVRQPPGKGLEWIGDIHHSGSTNYKPSLKSRVTISVDKSKNQFSLNLISVTAADTAVYYCAREAGGYFDYWGQGILVTVSSGGGGSGGGGSGGGGSGGGGSDIQMTQSPSTLSASVGDRVTITCRASQSISSWLAWYQQKPGKAPKLLISKASSLESGVPSRFSGSGSGPEFTLTISSLQPADFATYYCQQYNSYSTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 647 - protein, 490 aa, Artificial Sequence
  Description of Artificial Sequence: Synthetic polypeptide
MALPVTALLLPLALLLHAARPQVQLQQWGAGLLKPSETLSLTCAVYGGSFSGYYWTWIRQPPGKGLEWIGEITHSGSTNYNPSLKSRVSISVDTSKNQFSLKLSSVTAADTAVYYCARGEYGSGSRFDYWGQGTLVTVSSGGGGSGGGGSGGGGSGGGGSAIQMTQSPSSLSASVGDRVAITCRASQGIRDDLGWYQQKPGKAPKLLIYAASSLQSGVPSRFSGSGSDTDFTLTISSLQPEDFATYYCLQDYDYPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 648 - protein, 490 aa, Artificial Sequence
  Description of Artificial Sequence: Synthetic polypeptide
MALPVTALLLPLALLLHAARPQVQLQQWGAGLLKPSETLSLTCAVYGGSFSGYYWSWIRQPPGKGLEWIGEITHSGSTNYNPSLKSRVSISVDTSKNQFSLKLSSVTAADTAVYYCARGEYGSGSRFDYWGQGTLVTVSSGGGGSGGGGSGGGGSGGGGSAIQMTQSPSSLSASVGDRVALTCRASQGIRDDLGWYQQKPGKAPKLLIYAASSLQSGVPSRFSGSGSDTDFTLTISSLQPEDFATYYCLQDYDYPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 649 - protein, 491 aa, Artificial Sequence
  Description of Artificial Sequence: Synthetic polypeptide
MALPVTALLLPLALLLHAARPQVQLQQWGAGLLKPSETLSLTCAVYGGSFSAYYWNWIRQPPGKGLEWIGEINHSGSTNYNPSLKSRVTISVDTSKNQFSLNLTSLTAADTAVYYCARGLDSSGWYPFDYWGQGTLVTVSSGGGGSGGGGSGGGGSGGGGSDIQMTQSPSSVSASVGDRVTITCRASQGISSWLAWYQQKPGKAPKLLIYAASSLQSGVPSRFSGSGSGTDFTLTISSLQPEDFATYYCQQADSFPFTFGPGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 650 - protein, 486 aa, Artificial Sequence
  Description of Artificial Sequence: Synthetic polypeptide
MALPVTALLLPLALLLHAARPQVQLQQWGAGLLKPSETLSLTCAVFGGSFSGDYWSWIRQPPGKGLEWIGEINHSGITSFNPSLKSRVTISVDTSKNQFSLKLSSVTAADTAVYYCARGELGIPDNWGQGTLVTVSSGGGGSGGGGSGGGGSGGGGSDIQMTQSPSTLSASVGDRVTITCRASQSISRWLAWYQQKPGKAPKLLIYKASSLESGVPSRFSGSGSGTEFTLTISSLQPDDFATYYCQQYNSYSTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 651 - protein, 495 aa, Artificial Sequence
  Description of Artificial Sequence: Synthetic polypeptide
MALPVTALLLPLALLLHAARPQVQLQESGPGLVKPSGTLSLTCVVFGDSISSSNWWSWVRQPPGKGLEWIGEVFHSGSTNYNPSLKSRVTISVDKSKNQFSLKLSSVTAADTAVYYCARAAVAGALDYWGQGTLVTVSSGGGGSGGGGSGGGGSGGGGSDIVMTQSPDSLAVSLGERATINCKSSQSVLYSSNNKNYLAWYQQKPGQPPNLLVYWASTRESGVPDRFSGAGSGTDFTLTISSLQAEDVAVYYCQQYYGTSWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 652 - protein, 491 aa, Artificial Sequence
  Description of Artificial Sequence: Synthetic polypeptide
MALPVTALLLPLALLLHAARPQITLRESGPTLVKPTQTLTLTCTFSGFSLSTSGLGVGWIRQPPGEALEWLALIYWNDDKRYSPSLKSRLSITKDTSKNQVVLIMTNMDPVDTATYYCVHRRIAAPGSVYWGQGTLVTVSSGGGGSGGGGSGGGGSGGGGSDIQMTQSPSSVSASVGDRVTITCRASQGISSWLAWYQQKPGKAPKLLISAASSLQSGVPSRFSGSGSGTDFTLTISSLQPEDFATYYCHQANSFPFTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 653 - protein, 490 aa, Artificial Sequence
  Description of Artificial Sequence: Synthetic polypeptide
MALPVTALLLPLALLLHAARPQVQLVQSGAEVKKPGASVKVSCKVSGYTLTELSMHWVRQAPGKGPEGMGGFDPEDGKTIYAQKFQGRVTMTEDTSADTAYMELNSLRSEDTAVYYCATLLRGLDAFDVWGQGTMVTVSSGGGGSGGGGSGGGGSGGGGSDIQMTQSPSSLSASVGDRVTITCRASQGIRNDLGWYQQKPGKAPKRLIYAASSLQSGVPSRFSGSGSGTEFTLTISTLQPEDFATYYCLQHNSYPRTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 654 - protein, 491 aa, Artificial Sequence
  Description of Artificial Sequence: Synthetic polypeptide
MALPVTALLLPLALLLHAARPQVQLQQWGAGLLKPSETLSLTCAVYGGSFSGYYWRWIRQPPGKGLEWIGEISHSGSTNYNPSLKSRVTISVDTSKNQFSLKLSSVTAADTAVYYCAVRGYSYGYPLFDYWGQGTLVTVSSGGGGSGGGGSGGGGSGGGGSDIQMTQSPSSLSASVGDRVTITCRASQGIRNDLGWYQQKLGKAPKRLIYAASSLQSGVPSRFSGSGSGTEFTLTISSLQPEDFATYYCLQYNSYPRTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 655 - protein, 486 aa, Artificial Sequence
  Description of Artificial Sequence: Synthetic polypeptide
MALPVTALLLPLALLLHAARPQVQLQESGPGLVKPSGTLSLTCAVSGDSISSNWWTWVRQPPGKGLEWIGDIHHSGSTNYNPSLKSRVTMSVDKSENQFSLKLSSVTAADTAVFYCARDGGGTLDYWGQGTLVTVSSGGGGSGGGGSGGGGSGGGGSDIQMTQSPSTLSASVGDRVTITCRASQSISSWLAWYQQKPGKAPKLLIYKASTLESGVPSRFSGSGSGTEFTLTISSLQPDDFATYYCQQYNGYSTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 656 - protein, 495 aa, Artificial Sequence
  Description of Artificial Sequence: Synthetic polypeptide
MALPVTALLLPLALLLHAARPQVQLVQSGAEVKKPGSSVKVSCKASGGTFTNYCISWVRQAPGQGLEWMGGIIPIFGTTNYAQTFQGRVTITADKSTSTAYMELSSLRSEDTAVYYCARDNGDRYYYDMDVWGQGTTVTVSSGGGGSGGGGSGGGGSGGGGSQSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAVVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 657 - protein, 497 aa, Artificial Sequence
  Description of Artificial Sequence: Synthetic polypeptide
MALPVTALLLPLALLLHAARPQVPLVQSGAEVKKPGSSVKVSCKASGGTFSTYSISWVRQAPGQGLEWMGGIIPIFGTTNYAQKFQGRVTITADKSTSTAYMELSSLRSEDTAVYYCARDGEGSYYYYYGMDVWGQGTTVTVSSGGGGSGGGGSGGGGSGGGGSQSVLTQPPSVSAAPGQKVTISCSGSSSNIGNNYVSWYQQLPGTAPKLLIYDNNKRPSGIPDRFFGSKFGTSATLGITGLQTGDEADYYCGTWDSSLSAVVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 658 - protein, 490 aa, Artificial Sequence
  Description of Artificial Sequence: Synthetic polypeptide
MALPVTALLLPLALLLHAARPQVQLQESGPGLVKPSETLSLTCTVSGDSISSYYWSWIRQPPGKGLEWIGYMYYSGITNYNPSLKSRVNISLDTSKNQFSLKLGSVTAADTAVYYCARLSVAGFYFDYWGQGTLVTVSSGGGGSGGGGSGGGGSGGGGSEIVLTQSPGTLSLSPGERATLSCRASQSVTRSYLAWYQQKPGQAPRLLIYGASSRATDIPDRFSGSGSGTDFTLTINRLEPEDFAVYYCQQYGTSPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 659 - protein, 490 aa, Artificial Sequence
  Description of Artificial Sequence: Synthetic polypeptide
MALPVTALLLPLALLLHAARPQVQLQESGPGLVKPSETLSLTCTVSSDSISSYYWSWIRQPPGKGLEWISYIYYSGISNYNPSLKSRVSISVDTSKNQFSLRLSSVTAADTAVYYCARISVAGFFFDNWGQGTLVTVSSGGGGSGGGGSGGGGSGGGGSEIMLTQSPDTLSLSPGERATLSCRASQSVSSSYLAWYQQKPGQAPRLLIYGASSRAAGVPDRFSGSGSGTDFTLTISRLAPEDFVVYYCQQYGISPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 660 - protein, 498 aa, Artificial Sequence
  Description of Artificial Sequence: Synthetic polypeptide
MALPVTALLLPLALLLHAARPQVQLQQSGPGLVKPSQTLSLTCAISGDSVSSNSATWNWIRQSPSRGLEWLGRTYYRSKWYDDYAVSVKSRITINPDTSKNHLSLHLNSVTPEDTAVYYCAGGGLVGAPDGFDVWGQGTMVTVSSGGGGSGGGGSGGGGSGGGGSQSVLTQPPSASGTPGQRVTISCSGSSSNIGSDPVNWYQQLPGTAPKLLIYSNNQRPSGVPDRFSGSKSGTSASLAISGLQSEDEADYYCSAWDDSLNGYVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 661 - protein, 493 aa, Artificial Sequence
  Description of Artificial Sequence: Synthetic polypeptide
MALPVTALLLPLALLLHAARPQVQLVQSGAEVKKPGASVKVSCKASGYTFTGYSIHWVRQAPGQGLEWMGWINPNSGGTFYAQKFQGRVTMTRDTSISTVYMELSRLRSDDTAVYYCARDGWGDYYYYGLDVWGQGTTVTVSLGGGGSGGGGSGGGGSGGGGSDIQMTQSPSSVSASVGDRVTITCRASQDISSWLAWYQQKPGKAPKLLIYTASSLQGGVPSRFSGSGSGTDFTLTISSLQPEDLATYSCQQANVFPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 662 - protein, 493 aa, Artificial Sequence
  Description of Artificial Sequence: Synthetic polypeptide
MALPVTALLLPLALLLHAARPEVQLLESGGGLVQPGGSLRLSCAASGFTFSSYAMNWVRQAPGKGLEWVSTISGSGGSTYYADSVKGRFTISRDNSKNTLYLQMNSLRAEDTAVFYCAIDPEYYDILTGGDYWGQGTLVTVSSGGGGSGGGGSGGGGSGGGGSDIQMTQSPSAMSASVGDRVTITCRASQGISNYLAWFQQKPGKVPKRLIYAASSLQSGVPSRFSGSGSGTEFTLTISSLQPEDFATYFCLQHDSFPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 663 - protein, 490 aa, Artificial Sequence
  Description of Artificial Sequence: Synthetic polypeptide
MALPVTALLLPLALLLHAARPQVQLQESGPGLVKPSETLSLTCTVSSDSISNYYWSWIRQPPGKGLEWISYIYYSGITNYNPSLKSRVTISVDTSKNQFSLKLSSVTAADTAVYYCARITVTGFYFDYWGQGTLVTVSSGGGGSGGGGSGGGGSGGGGSEIVLTQSPGTLSLSPGERATLSCRASQSISRSYLAWYQQKPGQAPRHLIYGASSRATGIPDRFSGSGSGTDFILTISRLEPEDFAVYYCQQYDTSPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 664 - protein, 498 aa, Artificial Sequence
  Description of Artificial Sequence: Synthetic polypeptide
MALPVTALLLPLALLLHAARPQVQLQQSGPGLVKPSQTLSLTCAISGDSVSSNSVVWNWIRQSPSRGLEWLGRTYYRSKWYDDYAVSVKSRITINPDTSKNQFSLQLNSVTPEDTAVYHCARGGIVGAPDAFDIWGQGTMVTVSSGGGGSGGGGSGGGGSGGGGSQSVLTQPPSASGTPGQRVTISCSGSSSNIGSDPVSWYQQFPGTAPKLLIYTNNQRPSGVPDRFSGSKSGTSASLAISGLQSEDEADYYCAAWDDSLNGHVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 665 - protein, 498 aa, Artificial Sequence
  Description of Artificial Sequence: Synthetic polypeptide
MALPVTALLLPLALLLHAARPQVQLQQSGPGLVKPSQTLSLTCAISGDSVSSNSAVWNWIRQSPSRGLEWLGWTYYRSKYYNDYAVSLKSRITINPDTSKNQFSLQLNSLTPEDTAVYYCTRGGIVGAPDGFDIWGQGTMVTVSSGGGGSGGGGSGGGGSGGGGSQSALTQPPSASGTPGQRVTISCSGSNSNIGSNPINWYQQLPGTAPKLLIYSNNQRPSGVPDRFSGSKSGTSASLAISGLQSEDEADYYCAAWDDSLNGHVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 666 - protein, 490 aa, Artificial Sequence
  Description of Artificial Sequence: Synthetic polypeptide
MALPVTALLLPLALLLHAARPQVQLQESGPGLVKPSETLSLTCTVSGGSISSYYWSWIRQSPGKGLEWIGYVYYSDITNYNPSLKSRVTISVDTSKNQFSLNLNSVTAADTAFYFCARIGVAGFYFDYWGQGTLVTVSSGGGGSGGGGSGGGGSGGGGSEIVLTQSPDTLSLSPGERATLSCRASQSVSRRYLAWYQQKPGQAPRLLIYGASSRATGIPDRFSGSGSGTDFTLTISRLEPEDFEVYYCQQYGTSPITFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 667 - protein, 498 aa, Artificial Sequence
  Description of Artificial Sequence: Synthetic polypeptide
MALPVTALLLPLALLLHAARPQIQLQQSGPGLVKPSQTLSLTCAISGDSVSSNSAVWNWIRQSPSRGLEWLGRTYYRSKWYNDYAVSVKSRITIKPDTAKNQFSLQLNSVTPEDTAVYYFTRGGIVGAPDAFDIWGQGTMVTVSSGGGGSGGGGSGGGGSGGGGSQSVLTQPPSASGTPGQRVTISCSGSSSNIGSDPINWYQQVPGTAPKLLIYSNNQRPSGVPDRFSGSKSGTSASLAISGLQSEDEADYYCAAWDDSLNGYVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 668 - protein, 498 aa, Artificial Sequence
  Description of Artificial Sequence: Synthetic polypeptide
MALPVTALLLPLALLLHAARPQVQLQQSGPGLVKPSETLSLTCAISGDSVSSNSATWNWIRQSPSRGLEWLGRTYYRSEWYNDYAVSVKSRITINPDTSKNHLSLHLNSVTPEDTAVYYCAGGGIVGAPDGFDVWGQGTMVTVSSGGGGSGGGGSGGGGSGGGGSQSVLTQPPSASGTPGQRVTISCSGSSSNIGSDPVIWYQQLPRTAPKLLIYSNNQRPSGVPDRFSGSKSGTSASLAISGLQSEDEADYYCAAWDDSLNGYVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 669 - protein, 498 aa, Artificial Sequence
  Description of Artificial Sequence: Synthetic polypeptide
MALPVTALLLPLALLLHAARPQVQLQQSGPGLVKPSQTLSLTCAISGDSVSSNSATWNWIRQSPSTGLEWLARTYYRSKWYNDYEVSVKSQITINPDTSKNQFSLQLNSVTPEDTAVYYCARGGIVGAPDAFDIWGQGTMVTVSSGGGGSGGGGSGGGGSGGGGSQSVLTQPPSASGTPGQGVTISCSGSSSNIGSNPVNWYQQLPGTAPKLLIYSNNQRPSGVPDRFSDSKSGTSASLAISGLQSEDEADYYCSAWDDWLNGYVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 670 - protein, 489 aa, Artificial Sequence
  Description of Artificial Sequence: Synthetic polypeptide
MALPVTALLLPLALLLHAARPQVQLQESGPGLVKPSETLSLTCTVSGDSINNYFWSWIRQPPGKGLEWIGYFYHRGGNNYNPSLKSRVTISIDTSKNQFSLNLNSVTSADTAVYYCARLALAGFFFDYWGQGTLVTVSSGGGGSGGGGSGGGGSGGGGSDIQMTQSPSTLSASVGDRVTITCRASQSISSWLAWYQQKPGKAPKLLIYKASSLESGVPSRFSGSGSGTEFTLTISSLQPDDFATYYCQQYNSYSRTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 671 - protein, 497 aa, Artificial Sequence
  Description of Artificial Sequence: Synthetic polypeptide
MALPVTALLLPLALLLHAARPQVPLVQSGAEVKKPGSSVKVSCKASGGTFSTYSISWVRQAPGQGLEWMGGIIPIFGTTNYAQKFQGRVTITADKSTSTAYMELSSLRSEDTAVYYCARDGEGSYYYYYGMDVWGQGTTVTVSSGGGGSGGGGSGGGGSGGGGSQSVLTQPPSASGTPGQRVTISCSGSSSNIGSNYVYWYQQLPGTAPKLLIYSNNQRPSGVPDRFSGSKSGTSASLAISGLRSEDEADYYCAAWDDSLSGWVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 672 - protein, 494 aa, Artificial Sequence
  Description of Artificial Sequence: Synthetic polypeptide
MALPVTALLLPLALLLHAARPEVQLVESGGGLVQPGGSLRLSCAASGFTFSSYSMNWVRQAPGKGLEWVSYISSSSSTIYYADSVKGRFTISRDNAKNSLYLQMNSLRDEDTAVYYCARDKERRYYYYGMDVWGQGTTVTVSSGGGGSGGGGSGGGGSGGGGSEIVLTQSPDTLSLSPGERATLSCRASQSVSRRYLAWYQQKPGQAPRLLIYGASSRATGIPDRFSGSGSGTDFTLTISRLEPEDFAVYYCQQFGTSPITFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 673 - protein, 498 aa, Artificial Sequence
  Description of Artificial Sequence: Synthetic polypeptide
MALPVTALLLPLALLLHAARPQVQLQQSGPGLVKPSQTLSLACAISGDSVSSNSAIWNWIRQSPSRGLEWLGGTYYRSMWYNDYAVSVKSRITINPDTSKNQLSLQLNSVTPEDTAVYYCSRGGIVGVPDAFDIWGQGTMVTVSSGGGGSGGGGSGGGGSGGGGSQSVLTQPPSASGTPGQRVTISCSGSSSNIGSNTANWYQQLPGTAPRLLIYRNNQRPSGVPDRFSGSKSGTSASLAISGLQSEDEADYYCAAWDDSLNGYVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 674 - protein, 492 aa, Artificial Sequence
  Description of Artificial Sequence: Synthetic polypeptide
MALPVTALLLPLALLLHAARPQVQLQESGPGLVKPSETLSLTCNVSDGSISSYYWTWIRQPPGKGLDWIGYIFYSGTTNYNPSLKSRVTISLDTSKNQFSLKLTSMTAADTAVYYCARISEKSFYFDYWGQGTLVTVSSGGGGSGGGGSGGGGSGGGGSQSVLTQPPSASGTPGQRVTISCSGSSSNIGSNYVYWYQQLPGTAPKLLIYSNNQRPSGVPDRFSGSKSGTSASLAISGLRSEDEADYYCAPWDDSLSGRVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 675 - protein, 493 aa, Artificial Sequence
  Description of Artificial Sequence: Synthetic polypeptide
MALPVTALLLPLALLLHAARPQVQLVQSGAEVKRPGASVKVSCKASGYTFTSYYIHWVRQAPGQGLEWMGVIVPSGGSISYAQKFQGRVTMTRDTSTNIVYMELSSLRSEDTAVYYCARDRYYGDYYYGLDVWGQGTTVTVSSGGGGSGGGGSGGGGSGGGGSDIQMTQSPSSLSASVGDRVTITCRASQGINNFLAWFQQKPGKAPKSLIYAASSLQSGVPSKFSGSGSGTDFTLTIRSLQPEDFATYYCQHYNSYPITFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 676 - protein, 490 aa, Artificial Sequence
  Description of Artificial Sequence: Synthetic polypeptide
MALPVTALLLPLALLLHAARPQVHLQESGPGLVKPSETLSLTCTVSGGSISHYYWTWIRQPPGKGLEWIGYIYYSGITNFSPSLKSRVSISVDSSKNQFSLNLNSVTAADTAVYYCAGISLAGFYFDYWVQGTLVTVSSGGGGSGGGGSGGGGSGGGGSEIVLTQSPGTLSLSPGERATLSCRASQSVSRSYLAWYQQKPGQAPRLLIYGASSRATGVPDRFSGSGSGTDFTLTISRLEPEDFAVFYCQQYSISPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 677 - protein, 493 aa, Artificial Sequence
  Description of Artificial Sequence: Synthetic polypeptide
MALPVTALLLPLALLLHAARPQVQLQESGPGLVKPSETLSLTCTVSGVSISSYYWSWIRQPPGKGLEWIAYIYYSGNTNYSPSLKSRVTISVDTSKDQLSLKLSSVTAADTAVYYCTRGGSGTIDVFDIWGQGTMVAVSSGGGGSGGGGSGGGGSGGGGSQSVLTQPPSVSAAPGQKVTISCSGSSSNIGNNYVSWYQQLPGTAPKLLIYDNNKRPSGIPDRFSGSKSGTSATLGITGLQTGDEADYYCETWDSSLSAVVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 678 - protein, 495 aa, Artificial Sequence
  Description of Artificial Sequence: Synthetic polypeptide
MALPVTALLLPLALLLHAARPQVQLQQSGPGLVKPSQTLSLTCAISGDNVSTNSAAWNWIRQSPSRGLEWLGWTYYRSKWYNDYAVSLKSRININPDTSKNQFSLQLNSVTPEDTAVYYCARWVNRDVFDIWGQGTMVTVSSGGGGSGGGGSGGGGSGGGGSQSALTQPASVSGSPGQSITISCTGTSSDVGSYNLVSWYQQHPGKAPKLMIYEGSKRPSGVSNRFSGSKSGNTASLTISGLQAEDEADYYCCSYAGSSTWVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 679 - protein, 496 aa, Artificial Sequence
  Description of Artificial Sequence: Synthetic polypeptide
MALPVTALLLPLALLLHAARPQVQLVESGGGVVQPGRSLRLSCAASGFTFSSYGMHWVRQTPGKGLEWVAVISYDGNSNYYADSVKGRFTISRDNSKNTLYLQMNSLRAEDTAVYYCARDGATVTSYYYYGMDVWGQGTTVTVSSGGGGSGGGGSGGGGSGGGGSEIVLTQSPGTLSLSPGERATLSCRASQSVSRTYLAWYHQKPGQAPRLLIYGASSRATGISDRFSGSGSGTDFTLTISRLEPEDFAVYYCQQYGTSPITFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 680 - protein, 501 aa, Artificial Sequence
  Description of Artificial Sequence: Synthetic polypeptide
MALPVTALLLPLALLLHAARPQVQLQQSGPGLVKPSQTLSLTCAISGDSVSSNSAVWNWIRQSPSRGLEWLGRTYYRSKWYNDYAVSVKSRITINPDTSRNQFSLQLNSVTPEDTAVYYCARGGIVGAPDGFDIWGQGTMVTVSSGGGGSGGGGSGGGGSGGGGSDIVMTQSPDSLAVSLGERATINCKSSQSVLDSSNNNNYFAWYQQRPGQPPHLLIYWASSRESGVPDRFSGSGSGTDFTLTISSLQAEDVAVYYCQQYYSTPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 681 - protein, 495 aa, Artificial Sequence
  Description of Artificial Sequence: Synthetic polypeptide
MALPVTALLLPLALLLHAARPQVQLQQSGPGLVKPSQTLSLTCAISGDSVSSNTTAWKWSRQSPSKGLEWLGWTYYRSKWYYDYTVSVKSRITINPDTSKNQFSLQLNSVTPEDTAVYYCARWIFHDAFDIWGQGTMVTVSSGGGGSGGGGSGGGGSGGGGSQSALTQPPSASGTPGQRVTISCSGSSSNIGSNTVNWYQQLPGTAPKLLIYTNNQRPSGVPDRFSGSKSGTSASLAISGLQSEDEADYFCSTWDDSLNGPVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 682 - protein, 486 aa, Artificial Sequence
  Description of Artificial Sequence: Synthetic polypeptide
MALPVTALLLPLALLLHAARPQVQLQESGPGLVKPSETLSLTCTVSGDSISSLSWSWIRQTPGEGLEWIGYLYYSGSTDYNPSLKSRVTISVDTSKNQFSLKLRSVAAADTALYYCARGRRAFDIWGQGTMVTVSSGGGGSGGGGSGGGGSGGGGSDIQMTQSPSSLSASVGDRVTITCRGSQGISNYLAWFQQRPGKAPKSLIYAASSLESGVPSKFSGSGSGTDFTLTIISLQPEDFATYYCQQYYNYPITFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 683 - protein, 496 aa, Artificial Sequence
  Description of Artificial Sequence: Synthetic polypeptide
MALPVTALLLPLALLLHAARPQVQLVQSGAEVKKPGASVKVSCKASGYTFTGYYMHWVRQAPGQGLEWMGWINPNSGGTNYAQKFQGRVTMTRDTSVSTAYMELSRLTSDDTAIYYCAKDGGGDFYFYGMDVWGQGTTVTVSSGGGGSGGGGSGGGGSGGGGSQTVVTQEPSFSVSPGGTVTLTCGLSSGSVSTSYYPSCFQQTPGQAPRTLIYSTDTRSSGVPDRFSGSILGNKAALTITGAQADDESDYYCVLYMGSGISVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 684 - protein, 572 aa, Artificial Sequence
  Description of Artificial Sequence: Synthetic polypeptide
MALPVTALLLPLALLLHAARPGGGGSCPYSNPSLCSGGGGSGGGGSQLQLQESGPGLVKPSETLSLTCTVSGGSISSSSYYWGWIRQPPGKGLEWIGSIYYSGNIYHNPSLKSRVSISVDTSKNQFSLRLSSVTAADTAVYYCAREIIVGATHFDYWGQGTLVTVSSGGGGSGGGGSGGGGSGGGGSAIQMTQSPSSLSASVGDRVTITCRASQGIRNDLGWYQQKPGKAPELLIYAASSLQSGVPSRFSGSGSGTDFTLTISSLQPEDFATYYCLQDYNYPLTFGPGTKVDIKGSGGGGSCPYSNPSLCSGGGGSELPTQGTFSNVSTNVSPAKPTTTACPYSNPSLCTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 685 - protein, 542 aa, Artificial Sequence
  Description of Artificial Sequence: Synthetic polypeptide
MALPVTALLLPLALLLHAARPQLQLQESGPGLVKPSETLSLTCTVSGGSISSSSYYWGWIRQPPGKGLEWIGSIYYSGNIYHNPSLKSRVSISVDTSKNQFSLRLSSVTAADTAVYYCAREIIVGATHFDYWGQGTLVTVSSGGGGSGGGGSGGGGSGGGGSAIQMTQSPSSLSASVGDRVTITCRASQGIRNDLGWYQQKPGKAPELLIYAASSLQSGVPSRFSGSGSGTDFTLTISSLQPEDFATYYCLQDYNYPLTFGPGTKVDIKGSGGGGSCPYSNPSLCSGGGGSCPYSNPSLCSGGGGSTTTACPYSNPSLCTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 686 - protein, 530 aa, Artificial Sequence
  Description of Artificial Sequence: Synthetic polypeptide
MALPVTALLLPLALLLHAARPGGGGSCPYSNPSLCGGGGSQLQLQESGPGLVKPSETLSLTCTVSGGSISSSSYYWGWIRQPPGKGLEWIGSIYYSGNIYHNPSLKSRVSISVDTSKNQFSLRLSSVTAADTAVYYCAREIIVGATHFDYWGQGTLVTVSSGGGGSGGGGSGGGGSGGGGSAIQMTQSPSSLSASVGDRVTITCRASQGIRNDLGWYQQKPGKAPELLIYAASSLQSGVPSRFSGSGSGTDFTLTISSLQPEDFATYYCLQDYNYPLTFGPGTKVDIKGGGGSCPYSNPSLCGGGGSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 687 - protein, 525 aa, Artificial Sequence
  Description of Artificial Sequence: Synthetic polypeptide
MALPVTALLLPLALLLHAARPGGGGSCPYSNPSLCGGGGSCPYSNPSLCGGGGSQLQLQESGPGLVKPSETLSLTCTVSGGSISSSSYYWGWIRQPPGKGLEWIGSIYYSGNIYHNPSLKSRVSISVDTSKNQFSLRLSSVTAADTAVYYCAREIIVGATHFDYWGQGTLVTVSSGGGGSGGGGSGGGGSGGGGSAIQMTQSPSSLSASVGDRVTITCRASQGIRNDLGWYQQKPGKAPELLIYAASSLQSGVPSRFSGSGSGTDFTLTISSLQPEDFATYYCLQDYNYPLTFGPGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 688 - protein, 548 aa, Artificial Sequence
  Description of Artificial Sequence: Synthetic polypeptide
MALPVTALLLPLALLLHAARPQVQLQQSGPGLVKPSQTLSLTCAISGDSVSSNSATWNWIRQSPSRGLEWLGRTYYRSKWYDDYAVSVKSRITINPDTSKNHLSLHLNSVTPEDTAVYYCAGGGLVGAPDGFDVWGQGTMVTVSSGGGGSGGGGSGGGGSGGGGSQSVLTQPPSASGTPGQRVTISCSGSSSNIGSDPVNWYQQLPGTAPKLLIYSNNQRPSGVPDRFSGSKSGTSASLAISGLQSEDEADYYCSAWDDSLNGYVFGTGTKVTVLGSGGGGSCPYSNPSLCSGGGGSCPYSNPSLCSGGGGSTTTACPYSNPSLCTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 689 - protein, 536 aa, Artificial Sequence
  Description of Artificial Sequence: Synthetic polypeptide
MALPVTALLLPLALLLHAARPGGGGSCPYSNPSLCGGGGSQVQLQQSGPGLVKPSQTLSLTCAISGDSVSSNSATWNWIRQSPSRGLEWLGRTYYRSKWYDDYAVSVKSRITINPDTSKNHLSLHLNSVTPEDTAVYYCAGGGLVGAPDGFDVWGQGTMVTVSSGGGGSGGGGSGGGGSGGGGSQSVLTQPPSASGTPGQRVTISCSGSSSNIGSDPVNWYQQLPGTAPKLLIYSNNQRPSGVPDRFSGSKSGTSASLAISGLQSEDEADYYCSAWDDSLNGYVFGTGTKVTVLGGGGSCPYSNPSLCGGGGSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 690 - protein, 531 aa, Artificial Sequence
  Description of Artificial Sequence: Synthetic polypeptide
MALPVTALLLPLALLLHAARPGGGGSCPYSNPSLCGGGGSCPYSNPSLCGGGGSQVQLQQSGPGLVKPSQTLSLTCAISGDSVSSNSATWNWIRQSPSRGLEWLGRTYYRSKWYDDYAVSVKSRITINPDTSKNHLSLHLNSVTPEDTAVYYCAGGGLVGAPDGFDVWGQGTMVTVSSGGGGSGGGGSGGGGSGGGGSQSVLTQPPSASGTPGQRVTISCSGSSSNIGSDPVNWYQQLPGTAPKLLIYSNNQRPSGVPDRFSGSKSGTSASLAISGLQSEDEADYYCSAWDDSLNGYVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 691 - protein, 573 aa, Artificial Sequence
  Description of Artificial Sequence: Synthetic polypeptide
MALPVTALLLPLALLLHAARPGGGGSCPYSNPSLCSGGGGSGGGGSEVQLLESGGGLVQPGGSLRLSCAASGFTFSSYAMNWVRQAPGKGLEWVSTISGSGGSTYYADSVKGRFTISRDNSKNTLYLQMNSLRAEDTAVFYCAIDPEYYDILTGGDYWGQGTLVTVSSGGGGSGGGGSGGGGSGGGGSDIQMTQSPSAMSASVGDRVTITCRASQGISNYLAWFQQKPGKVPKRLIYAASSLQSGVPSRFSGSGSGTEFTLTISSLQPEDFATYFCLQHDSFPLTFGGGTKVEIKGSGGGGSCPYSNPSLCSGGGGSELPTQGTFSNVSTNVSPAKPTTTACPYSNPSLCTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 692 - protein, 543 aa, Artificial Sequence
  Description of Artificial Sequence: Synthetic polypeptide
MALPVTALLLPLALLLHAARPEVQLLESGGGLVQPGGSLRLSCAASGFTFSSYAMNWVRQAPGKGLEWVSTISGSGGSTYYADSVKGRFTISRDNSKNTLYLQMNSLRAEDTAVFYCAIDPEYYDILTGGDYWGQGTLVTVSSGGGGSGGGGSGGGGSGGGGSDIQMTQSPSAMSASVGDRVTITCRASQGISNYLAWFQQKPGKVPKRLIYAASSLQSGVPSRFSGSGSGTEFTLTISSLQPEDFATYFCLQHDSFPLTFGGGTKVEIKGSGGGGSCPYSNPSLCSGGGGSCPYSNPSLCSGGGGSTTTACPYSNPSLCTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 693 - protein, 531 aa, Artificial Sequence
  Description of Artificial Sequence: Synthetic polypeptide
MALPVTALLLPLALLLHAARPGGGGSCPYSNPSLCGGGGSEVQLLESGGGLVQPGGSLRLSCAASGFTFSSYAMNWVRQAPGKGLEWVSTISGSGGSTYYADSVKGRFTISRDNSKNTLYLQMNSLRAEDTAVFYCAIDPEYYDILTGGDYWGQGTLVTVSSGGGGSGGGGSGGGGSGGGGSDIQMTQSPSAMSASVGDRVTITCRASQGISNYLAWFQQKPGKVPKRLIYAASSLQSGVPSRFSGSGSGTEFTLTISSLQPEDFATYFCLQHDSFPLTFGGGTKVEIKGGGGSCPYSNPSLCGGGGSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 694 - protein, 526 aa, Artificial Sequence
  Description of Artificial Sequence: Synthetic polypeptide
MALPVTALLLPLALLLHAARPGGGGSCPYSNPSLCGGGGSCPYSNPSLCGGGGSEVQLLESGGGLVQPGGSLRLSCAASGFTFSSYAMNWVRQAPGKGLEWVSTISGSGGSTYYADSVKGRFTISRDNSKNTLYLQMNSLRAEDTAVFYCAIDPEYYDILTGGDYWGQGTLVTVSSGGGGSGGGGSGGGGSGGGGSDIQMTQSPSAMSASVGDRVTITCRASQGISNYLAWFQQKPGKVPKRLIYAASSLQSGVPSRFSGSGSGTEFTLTISSLQPEDFATYFCLQHDSFPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 695 - protein, 12 aa, Artificial Sequence
  Description of Artificial Sequence: Synthetic peptide
GYIFYSGTTNHN

SEQ ID NO: 696 - protein, 12 aa, Artificial Sequence
  Description of Artificial Sequence: Synthetic peptide
RASQRISNTYLA

What is claimed is:

1. A chimeric antigen receptor comprising an extracellular domain, a transmembrane domain, and an intracellular domain, wherein the extracellular domain comprises a DLL3 antigen binding domain of an antibody that specifically binds to DLL3, and wherein the antigen binding domain comprises:
   (a) a variable heavy chain CDR1 comprising the amino acid sequence shown as SEQ ID NO: 109;
   (b) a variable heavy chain CDR2 comprising the amino acid sequence shown as SEQ ID NO: 110;
   (c) a variable heavy chain CDR3 comprising the amino acid sequence shown as SEQ ID NO: 111;
   (d) a variable light chain CDR1 comprising the amino acid sequence shown as SEQ ID NO: 112;
   (e) a variable light chain CDR2 comprising the amino acid sequence shown as SEQ ID NO: 113; and
   (f) a variable light chain CDR3 comprising the amino acid sequence shown as SEQ ID NO: 114.

2. A chimeric antigen receptor comprising an extracellular domain, a transmembrane domain, and an intracellular domain, wherein the extracellular domain comprises a DLL3 antigen binding domain of an antibody that specifically binds to DLL3, and wherein the antigen binding domain comprises:
   (a) a variable heavy chain comprising the amino acid sequence shown as SEQ ID NO: 115; and
   (b) a variable light chain comprising the amino acid sequence shown as SEQ ID NO: 116,
   wherein the variable heavy chain and the variable light chain is linked by at least one linker.

3. The chimeric antigen receptor of claim 1, wherein the antigen binding domain comprises the scFv sequence shown as SEQ ID NO: 117.

4. The chimeric antigen receptor of claim 1, wherein the chimeric antigen receptor comprises an amino acid sequence that is 100% identical to SEQ ID NO: 644.

5. The chimeric antigen receptor of claim 1, wherein the intracellular domain comprises at least one costimulatory domain.

6. The chimeric antigen receptor of claim 5, wherein the costimulatory domain is a signaling region of CD28, OX-40, 4-1BB/CD137, CD2, CD7, CD27, CD30, CD40, programmed death-1 (PD-1), inducible T cell costimulator (ICOS), lymphocyte function-associated antigen-1 (LFA-1 (CD1 1a/CD18), CD3 gamma, CD3 delta, CD3 epsilon, CD247, CD276 (B7-H3), LIGHT, (TNFSF14), NKG2C, Ig alpha (CD79a), DAP-10, Fc gamma receptor, MHC class I molecule, TNF receptor protein, an Immunoglobulin protein, cytokine receptor, integrin, Signaling Lymphocytic Activation Molecule (SLAM protein), activating NK cell receptor, BTLA, a Toll-like receptor, ICAM-1, B7-H3, CDS, ICAM-1, GITR, BAFFR, LIGHT, HVEM (LIGHTR), KIRDS2, SLAMF7, NKp80 (KLRF1), NKp44, NKp30, NKp46, CD19, CD4, CD8alpha, CD8beta, IL-2R beta, IL-2R gamma, IL-7R alpha, ITGA4, VLA1, CD49a, ITGA4, CD49D, ITGA6, VLA-6, CD49f, ITGAD, CD1 1d, ITGAE, CD103, ITGAL, CD1 1a, LFA-1, ITGAM, CD1 1b, ITGAX, CD1 1c, ITGB1, CD29, ITGB2, CD18, LFA-1, ITGB7, NKG2D, TNFR2, TRANCE/RANKL, DNAMI (CD226), SLAMF4 (CD244, 2B4), CD84, CD96 (Tactile), CEACAM1, CRT AM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, CD19a, a ligand that specifically binds with CD83, or any combination thereof.

7. The chimeric antigen receptor of claim 6, wherein the costimulatory domain comprises a signaling region of 4-1BB/CD137.

8. The chimeric antigen receptor of claim 7, wherein the 4-1BB/CD137 costimulatory domain comprises SEQ ID NO: 480.

9. The chimeric antigen receptor of claim 1, wherein the intracellular domain comprises at least one activating domain.

10. The chimeric antigen receptor of claim 9, wherein the activating domain comprises CD3.

11. The chimeric antigen receptor of claim 10, wherein the CD3 comprises CD3 zeta.

12. The chimeric antigen receptor of claim 11, wherein the CD3 zeta comprises SEQ ID NO: 481.

13. The chimeric antigen receptor of claim 1, further comprising a safety switch.

14. The chimeric antigen receptor of claim 13, wherein the safety switch comprises one or more CD20 mimotopes comprising SEQ ID NO:536 or one or more QBEND-10 epitopes comprising SEQ ID NO: 471, SEQ ID NO: 544, or combinations thereof.

15. The chimeric antigen receptor of claim 14, wherein the chimeric antigen receptor comprises one or more safety switches in the format of
   a) QR3 comprising CD8αsignal sequence-linker-CD20 mimotope-linker-anti-DLL3 ScFv-linker-CD20 mimotope-linker-QBEND-10 epitope-linker-CD20 mimotope-hinge and transmembrane regions of human CD8αmolecule-41BB signaling domain-CD3θsignaling domain,
   b) SR2 comprising CD8αsignal sequence-anti-DLL3 ScFv-linker-CD20 mimotope-linker-CD20 mimotope-linker-hinge and transmembrane regions of human CD8αmolecule-41BB signaling domain-CD3θsignaling domain,
   c) RSR comprising CD8αsignal sequence-linker-CD20 mimotope-linker-anti-DLL3 ScFv-linker-CD20 mimotope-linker-hinge and transmembrane regions of human CD8αmolecule-41BB signaling domain-CD3θsignaling domain, or
   d) R2S comprising CD8αsignal sequence-linker-CD20 mimotope-linker-CD20 mimotope-linker-anti-DLL3 ScFv-linker-hinge and transmembrane regions of human CD8αmolecule-41BB signaling domain-CD3θsignaling domain.

16. The chimeric antigen receptor of claim 13, wherein the chimeric antigen receptor comprises the amino acid sequence that is 100% identical to SEQ ID NO: 686.

17. An engineered immune cell expressing the chimeric antigen receptor of claim 1.

18. A pharmaceutical composition comprising the engineered immune cell of claim 17.

19. A method of treating cancer in a subject in need thereof comprising administering to the subject the engineered immune cell of claim 17.

20. The method of claim 19, wherein the cancer is small cell lung cancer.

21. An article of manufacture comprising the engineered immune cell of claim 17.

22. An anti-DLL3 binding agent comprising an antigen binding domain of an antibody that specifically binds to DLL3, comprising:
   (a) a variable heavy chain CDR1 comprising the amino acid sequence shown as SEQ ID NO: 109;
   (b) a variable heavy chain CDR2 comprising the amino acid sequence shown as SEQ ID NO: 110;
   (c) a variable heavy chain CDR3 comprising the amino acid sequence shown as SEQ ID NO: 111;
   (d) a variable light chain CDR1 comprising the amino acid sequence shown as SEQ ID NO: 112;
   (e) a variable light chain CDR2 comprising the amino acid sequence shown as SEQ ID NO: 113; and
   (f) a variable light chain CDR3 comprising the amino acid sequence shown as SEQ ID NO: 114.

23. The DLL3 binding agent of claim 22, wherein the binding agent is an antibody, an antibody conjugate, or an antigen-binding fragment thereof, optionally, a F(ab')$_2$ fragment, a Fab' fragment, a Fab fragment, a Fv fragment, a scFv fragment, and a dsFv fragment.

24. The anti-DLL3 binding agent of claim 23, wherein the binding agent is a monoclonal antibody comprising an IgG constant region.

25. The anti-DLL3 binding agent of claim 22, comprising a variable heavy (VH) chain sequence that is 100% identical to a VH sequence shown as SEQ ID NO: 115.

26. The anti-DLL3 binding agent of claim 22, comprising a variable light (VL) chain sequence that is 100% identical to a VL sequence shown as SEQ ID NO: 116.

27. The anti-DLL3 binding agent of claim 22, wherein the binding agent comprises a sequence that is 100% identical to a single chain Fv (scFv) shown as SEQ ID NO: 117.

28. The anti-DLL3 binding agent of claim 22, wherein the binding agent is a fusion protein comprising a scFv fragment fused to an Fc constant region.

29. A pharmaceutical composition comprising the anti-DLL3 binding agent of claim 22 and a pharmaceutically acceptable excipient.

30. A method of treating a cancer in a subject in need thereof comprising administering to the subject anti-DLL3 binding agent of claim 22.

31. The method of claim 30, wherein the cancer is small cell lung cancer.

* * * * *

UNITED STATES PATENT AND TRADEMARK OFFICE
CERTIFICATE OF CORRECTION

PATENT NO. : 11,673,953 B2
APPLICATION NO. : 16/802822
DATED : June 13, 2023
INVENTOR(S) : Yi Zhang et al.

It is certified that error appears in the above-identified patent and that said Letters Patent is hereby corrected as shown below:

In the Claims

In Column 199, Line 9 (Claim 15, Line 4) after "CD8α" insert space.

In Column 199, Line 14 (Claim 15, Line 8) after "CD8α" insert space.

In Column 199, Line 15 (Claim 15, Line 9) "CD3θsignaling domain" should read as: CD3ζ signaling domain.

In Column 199, Line 16 (Claim 15, Line 10) after "CD8α" insert space.

In Column 199, Line 19 (Claim 15, Line 13) after "CD8α" insert space.

In Column 199, Line 20 (Claim 15, Line 14) "CD3θsignaling domain" should read as: CD3ζ signaling domain.

In Column 199, Line 21 (Claim 15, Line 15) after "CD8α" insert space.

In Column 199, Line 24 (Claim 15, Line 18) after "CD8α" insert space.

In Column 199, Line 25 (Claim 15, Line 19) "CD3θsignaling domain" should read as: CD3ζ signaling domain.

In Column 199, Line 26 (Claim 15, Line 20) after "CD8α" insert space.

In Column 199, Line 29 (Claim 15, Line 23) after "CD8α" insert space.

In Column 199, Line 30 (Claim 15, Line 24) "CD3θsignaling domain" should read as: CD3ζ signaling domain.

Signed and Sealed this
Fifteenth Day of August, 2023

Katherine Kelly Vidal
*Director of the United States Patent and Trademark Office*